United States Patent
Fernandes et al.

(10) Patent No.: US 11,976,277 B2
(45) Date of Patent: May 7, 2024

(54) PARTICLE DELIVERY SYSTEMS

(71) Applicant: Scribe Therapeutics Inc., Alameda, CA (US)

(72) Inventors: Jason Fernandes, Redwood City, CA (US); Sean Higgins, Alameda, CA (US); Isabel Colin, Oakland, CA (US); Hannah Spinner, Boston, MA (US); Matthew Gardner, Berkeley, CA (US); Trent Gomberg, San Diego, CA (US); Gayathri Vijayakumar, Oakland, CA (US); Sarah Denny, San Francisco, CA (US); Brett T. Staahl, Tiburon, CA (US); Maroof Adil, Davis, CA (US); Benjamin Oakes, El Cerrito, CA (US); Angus Sidore, Oakland, CA (US); Suraj Makhija, San Francisco, CA (US)

(73) Assignee: Scribe Therapeutics Inc., Alameda, CA (US)

( * ) Notice: Subject to any disclaimer, the term of this patent is extended or adjusted under 35 U.S.C. 154(b) by 0 days.

(21) Appl. No.: 18/164,138

(22) Filed: Feb. 3, 2023

(65) Prior Publication Data
US 2023/0183691 A1    Jun. 15, 2023

Related U.S. Application Data

(63) Continuation of application No. PCT/US2022/032579, filed on Jun. 7, 2022.

(60) Provisional application No. 63/285,420, filed on Dec. 2, 2021, provisional application No. 63/208,932, filed on Jun. 9, 2021.

(51) Int. Cl.
| | |
|---|---|
| *C12N 15/113* | (2010.01) |
| *A61K 9/00* | (2006.01) |
| *A61K 9/50* | (2006.01) |
| *C07K 14/005* | (2006.01) |
| *C12N 9/22* | (2006.01) |
| *C12N 15/11* | (2006.01) |

(52) U.S. Cl.
CPC .......... *C12N 15/111* (2013.01); *A61K 9/0019* (2013.01); *A61K 9/5052* (2013.01); *C07K 14/005* (2013.01); *C12N 9/22* (2013.01); *C12N 2310/16* (2013.01); *C12N 2310/20* (2017.05); *C12N 2310/3519* (2013.01); *C12N 2320/32* (2013.01)

(58) Field of Classification Search
CPC .... C12N 15/111; C12N 9/22; C12N 2310/16; C12N 2310/20; C12N 2310/3519; C12N 2320/32; A61K 9/0019; A61K 9/5052; C07K 14/005
See application file for complete search history.

(56) References Cited

U.S. PATENT DOCUMENTS

| | | |
|---|---|---|
| 5,175,099 A | 12/1992 | Wills |
| 5,744,326 A | 4/1998 | Ill et al. |
| 8,920,812 B2 | 12/2014 | Haynes |
| 9,322,037 B2 | 4/2016 | Liu et al. |
| 10,570,415 B2 | 2/2020 | Doudna et al. |
| 10,968,253 B2 | 4/2021 | Ohlmann et al. |
| 10,988,779 B2 | 4/2021 | Park et al. |
| 11,535,835 B1 | 12/2022 | Oakes et al. |
| 11,560,555 B2 | 1/2023 | Oakes et al. |
| 11,613,742 B2 | 3/2023 | Oakes et al. |
| 11,649,264 B2 | 5/2023 | Ohlmann et al. |
| 11,795,472 B2 | 10/2023 | Doudna et al. |
| 2002/0168346 A1 | 11/2002 | Leboulch et al. |
| 2004/0022811 A1 | 2/2004 | Kelly et al. |
| 2004/0137071 A1 | 7/2004 | Unger |
| 2005/0009743 A1 | 1/2005 | Sundquist et al. |
| 2011/0189159 A1 | 8/2011 | Chatterjee et al. |
| 2017/0369870 A1 | 12/2017 | Gill et al. |
| 2018/0030429 A1 | 2/2018 | King et al. |
| 2018/0092854 A1 | 4/2018 | Prestidge et al. |
| 2018/0200359 A1 | 7/2018 | Puckette et al. |
| 2018/0258424 A1 | 9/2018 | Greenberg et al. |
| 2018/0346927 A1 | 12/2018 | Doudna et al. |
| 2019/0010518 A1 | 1/2019 | Quake et al. |
| 2019/0276842 A1 | 9/2019 | Doudna et al. |
| 2020/0017879 A1 | 1/2020 | Doudna et al. |
| 2020/0140887 A1 | 5/2020 | Park et al. |
| 2021/0106632 A1 | 4/2021 | Kim et al. |
| 2021/0139892 A1 | 5/2021 | Wilson et al. |

(Continued)

FOREIGN PATENT DOCUMENTS

| | | |
|---|---|---|
| BR | PI-0709613-5 A2 | 7/2011 |
| EP | 3 365 437 A1 | 8/2018 |

(Continued)

OTHER PUBLICATIONS

Wendy Dong and Boris Kantor (Viruses Jul. (2021); 13(7); 1288; pp. 1-17). (Year: 2021).*

(Continued)

*Primary Examiner* — J. E. Angell
(74) *Attorney, Agent, or Firm* — Cooley LLP

(57) ABSTRACT

Provided herein are delivery particle systems (XDP) useful for the delivery of payloads of any type. In some embodiments, a XDP particle system with tropism for target cells of interest is used to deliver CRISPR/Cas polypeptides (e.g., CasX proteins) and guide nucleic acids (gNA), for the modification of nucleic acids in target cells. Also provided are methods of making and using such XDP to modify the nucleic acids in such cells.

23 Claims, 130 Drawing Sheets
Specification includes a Sequence Listing.

(56) References Cited

U.S. PATENT DOCUMENTS

| | | |
|---|---|---|
| 2021/0261957 A1 | 8/2021 | Petris et al. |
| 2021/0284697 A1 | 9/2021 | Ohlmann et al. |
| 2021/0284981 A1 | 9/2021 | Doudna et al. |
| 2021/0309981 A1 | 10/2021 | Doudna et al. |
| 2021/0353543 A1 | 11/2021 | Trudeau et al. |
| 2022/0081681 A1 | 3/2022 | Oakes et al. |
| 2022/0090036 A1 | 3/2022 | Oakes et al. |
| 2022/0177872 A1 | 6/2022 | Oakes et al. |
| 2022/0220508 A1 | 7/2022 | Oakes et al. |
| 2022/0348925 A1 | 11/2022 | Oales et al. |
| 2023/0032369 A1 | 2/2023 | Oakes et al. |
| 2023/0033866 A1 | 2/2023 | Oakes et al. |
| 2023/0054437 A1 | 2/2023 | Vijayakumar et al. |
| 2023/0081117 A1 | 3/2023 | Oakes et al. |
| 2023/0124880 A1 | 4/2023 | Oakes et al. |
| 2023/0167424 A1 | 6/2023 | Oakes et al. |
| 2023/0193255 A1 | 6/2023 | Doudna et al. |

FOREIGN PATENT DOCUMENTS

| | | |
|---|---|---|
| EP | 2 739 725 B1 | 11/2019 |
| WO | WO-92/12237 A1 | 7/1992 |
| WO | WO-94/16737 A1 | 8/1994 |
| WO | WO-2010/040023 A2 | 4/2010 |
| WO | WO-2010/040023 A3 | 4/2010 |
| WO | WO-2010/075303 A1 | 7/2010 |
| WO | WO-2012/068627 A1 | 5/2012 |
| WO | WO-2017/068077 A1 | 4/2017 |
| WO | WO-2017/181119 A2 | 10/2017 |
| WO | WO-2017/181119 A3 | 10/2017 |
| WO | WO-2018/064371 A1 | 4/2018 |
| WO | WO-2018/195555 A1 | 10/2018 |
| WO | WO-2018/204694 A1 | 11/2018 |
| WO | WO-2020/023529 A1 | 1/2020 |
| WO | WO-2020/041456 A1 | 2/2020 |
| WO | WO-2020/102709 A1 | 5/2020 |
| WO | WO-2020/160418 A1 | 8/2020 |
| WO | WO-2020/247882 A1 | 12/2020 |
| WO | WO-2020/247883 A2 | 12/2020 |
| WO | WO-2020/247883 A3 | 12/2020 |
| WO | WO-2021/050593 A1 | 3/2021 |
| WO | WO-2021/050601 A1 | 3/2021 |
| WO | WO-2021/113763 A1 | 6/2021 |
| WO | WO-2021/113769 A1 | 6/2021 |
| WO | WO-2021/113772 A1 | 6/2021 |
| WO | WO-2021/142342 A1 | 7/2021 |
| WO | WO-2021/188729 A1 | 9/2021 |
| WO | WO-2022/120089 A1 | 6/2022 |
| WO | WO-2022/120094 A2 | 6/2022 |
| WO | WO-2022/120094 A3 | 6/2022 |
| WO | WO-2022/120095 A1 | 6/2022 |
| WO | WO-2022/261148 A1 | 12/2022 |
| WO | WO-2022/261149 A1 | 12/2022 |
| WO | WO-2022/261149 A2 | 12/2022 |
| WO | WO-2022/261149 A3 | 12/2022 |
| WO | WO-2022/261150 A2 | 12/2022 |
| WO | WO-2022/261150 A3 | 12/2022 |
| WO | WO-2023/049742 A2 | 3/2023 |

OTHER PUBLICATIONS

Frecha, C. et al. (2012). "A novel lentiviral vector targets gene transfer into human hematopoietic stem cells in marrow from patients with bone marrow failure syndrome and in vivo in humanized mice," Blood 119:1139-1150.

Girard-Gagnepain, A. et al. (2014). "Baboon envelope pseudotyped LVs outperform VSV-G-LVs for gene transfer into early-cytokine-stimulated and resting HSCs," Blood 124:1221-1231.

Rajawat, Y.S. et al. (2021). "In vivo gene therapy for canine SCID-X1 using cocal-pseudotyped lentiviral vector," Human Gene Ther. 32:113-127.

U.S. Appl. No. 18/168,426, by Benjamin Oakes et al., filed Feb. 13, 2023 (Copy not attached).

Adamson, C.S. & Freed, E.O. (2007). "Human immunodeficiency virus type 1 assembly, release, and maturation," Adv. Pharmacol. 55:347-387.

Aguilera, T.A. et al. (Jun. 2009). "Systemic in vivo distribution of activatable cell penetrating peptides is superior to that of cell penetrating peptides," Integr. Biol. (Camb) 1(5-6):371-381, 22 total pages.

Alerasool, N. et al. (2020). "An efficient KRAB domain for CRISPRi applications," Nat. Methods 17:1093-1096, 14 total pages.

Althof, N. et al. (2013). "Coxsackievirus B3 Infects the Bone Marrow and Diminishes the Restorative Capacity of Erythroid and Lymphoid Progenitors," J. Virol. 87:2823-2834.

Altschul, S.F. et al. (Oct. 1990). "Basic local alignment search tool," J. Mol. Biol. 215:403-410.

Aoki, T. et al. (2011). "Protein transduction by pseudotyped lentivirus-like Nanoparticles," Gene Therapy 18:936-941.

Aubin-Tam, M-E. (2013). "Conjugation of nanoparticles to proteins," Methods of Molecular Biology 1025:19-27.

Banerjee, P. et al. (2010). "Hematopoietic stem cells and retroviral infection," Retrovirology 7:8, 17 total pages.

Basmaciogullari, S. & Pizzato M. (2014). "The activity of Nef on HIV-1 infectivity," Frontiers Microbiol 5:232, 12 total pages.

Bell, A.J. et al. (2010). "RD114 envelope proteins provide an effective and versatile approach to pseudotype lentiviral vectors," Exp. Biol. Med. 235:1269-1276.

Bender, R.R. et al. (2016). "Receptor-Targeted Nipah Virus Glycoproteins Improve Cell-Type Selective Gene Delivery and Reveal a Preference for Membrane-Proximal Cell Attachment," PLoS Pathogens 12:e1005641, 28 total pages.

Brouns, S.J.J. et al. (2008). "Small CRISPR RNAs Guide Antiviral Defense in Prokaryotes," Science 321:960-964.

Buenrostro, J.D. et al. (2014). "Quantitative analysis of RNA-protein interactions on a massively parallel array reveals biophysical and evolutionary landscapes," Nat Biotechnol. 32:562-568, 19 total pages.

Burstein, D. et al. (Feb. 2017). "New CRISPR-Cas systems from uncultivated microbes," Nature 542:237-241. Published online Dec. 22, 2016, with Supplemental Materials, 28 total pages.

Cai, Y. et al. (2014). "Targeted genome editing by lentiviral protein transduction of zinc-finger and TAL-effector nucleases," eLife 3:e01911, 19 total pages.

Cai, Y. et al. (2014). "Targeted genome editing by lentiviral protein transduction of ZFN and Cas9 proteins," Human Gene Therapy 25:A31.

Cai, Y. et al. (2016). "Lentiviral Delivery of Proteins for Genome Engineering," Current Gene Therapy 16:194-206.

Cai, Y. et al. (2014). "DNA transposition by protein transduction of the *piggyBac* transposase from lentiviral Gag precursors," Nucl Acids Res. 42:e28.

Campbell, L.A. et al. (2018). "Gesicle-Mediated Delivery of CRISPR/Cas9 Ribonucleoprotein Complex for Inactivating the HIV Provirus," Mol. Ther. 27:151-163.

Carlsson, K. et al. (2020). Exosomes and lipid nanoparticles—the future of targeted drug delivery, Uppsala Universitet, 1MB332, Independent Project in Molecular Biotechnology, 15 hp, spring semester 2020 Master Programme in Molecular Biotechnology Engineering Biology Education Centre, Uppsala University, 109 total pages.

Cebrian-Serrano, A. et al. (2017). "CRISPR-Cas orthologues and variants: optimizing the repertoire, specificity and delivery of genome engineering tools," Mamm Genome 28:247-261.

Choi, J.C. et al. (2016). "Lentivirus pre-packed with Cas9 protein for safer gene editing," Gene Therapy 23:627-633.

Chylinski, K. et al. (2014). "Classification and evolution of type II CRISPR-Cas systems," Nucleic Acids Research 42:6091-6105.

Cronin, J. et al. (2005). "Altering the Tropism of Lentiviral Vectors through Pseudotyping," Curr. Gene Ther. 5:387-398.

Cullen, B.R. et al. (1991). "Human immunodeficiency virus as a prototypic complex retrovirus," J. Virol. 65:1053-1056.

Cullen, B.R. et al. et al. (1989). "Regulatory pathways governing HIV-1 replication," Cell 58:423-426.

Das, A.T. et al. (2011). "The HIV-I Tat Protein Has a Versatile Role in Activating Viral Transcription," J Virol. 85:9506-9516.

(56) References Cited

OTHER PUBLICATIONS

Desmaris, N. et al. (2001). "Production and Neurotropism of Lentivirus Vectors Pseudotyped with Lyssavirus Envelope Glycoproteins," Mol. Ther. 4:149-156.
Extended European Search Report dated Oct. 25, 2022, for EP Application No. 19 885 528.0, filed on Nov. 15, 2019, 16 pages.
Eyckerman, S. et al. (2016). "Trapping mammalian protein complexes in viral Particles," Nature Comm. 7:11416.
Finkelshtein, D., et al. (2013). "LDL receptor and its family members serve as the cellular receptors for vesicular stomatitis virus," PNAS 110:7306-7311.
Fogeda, M. et al. (1999). "In Vitro Infection of Human Peripheral Blood Mononuclear Cells by GB Virus C/Hepatitis G Virus," J. Virol. 73:4052-4061.
Frank, A.M. et al. (2018). "Surface-Engineered Lentiviral Vectors for Selective Gene Transfer into Subtypes of Lymphocytes," Molecular Therapy: Methods & Clinical Development 12:19-31.
Fritz, C.C. et al. (1996). "HIV Rev uses a conserved cellular protein export pathway for the nucleocytoplasmic transport of viral RNAs," Current Biol. 67:848-854.
Fu, S. et al. (2018). "Correlation of CRM1-NES affinity with nuclear export activity," Mol. Biol. Cell. 29:2037-2044.
Fuguo, J. et al. (2015). "The structural biology of CRISPR-Cas systems," Current Opinion in Structural Biology 30:100-111.
Gaj, T. et al. (2013). "ZFN, TALEN, and CRISPR/Cas-based methods for genome engineering," Trends Biotechnol. 31:397-405.
Gee, P. et al. (2020). "Extracellular nanovesicles for packaging of CRISPRCas9 protein and sgRNA to induce therapeutic exon skipping," Nature Comm. 11:1334, 18 total pages.
Gheysen, D. et al. (1989). "Assembly and release of HIV-1 precursor Pr55Gag virus-like particles from recombinant baculovirus-infected insect cells," Cell 59:103-112.
Giulietti, M. et al. (2015). "ExportAid: database of RNA elements regulating nuclear RNA export in mammals," Bioinformatics 31:246-251.
Goldman, M.J. et al. (1997). "Lentiviral vectors for gene therapy of cystic fibrosis," Human Gene Therapy 8:2261-2268.
Gonzalez, M.E. (2015). "Vpu Protein: The Viroporin Encoded by HIV-1," Viruses 7:4352-4368.
Hachiya, A. et al. (2007). "Gene transfer in human skin with different pseudotyped HIV-based vectors," Gene Therapy 14:648-656.
Hackett, P.B. et al. (2014). "Delivering the second revolution in site-specific nucleases," eLife 3:e02904.
Hanawa, H. et al. (2002). "Comparison of Various Envelope Proteins for Their Ability to Pseudotype Lentiviral Vectors and Transduce Primitive Hematopoietic Cells from Human Blood," Mol. Ther. 5:242-251.
Harrison M.S. et al. (2010). "Paramyxovirus assembly and budding: building particles that transmit infections," Int. J. Biochem. Cell. Biol. 42:1416-1429.
Hendel, A. et al. (2015). "Chemically modified guide RNAs enhance CRISPR-Cas genome editing in human primary cells," Nature Biotechnology 33:985-989.
Hernández-Giottonini, K.Y. et al. (2020). "PLGA nanoparticle preparations by emulsification and (nanoprecipitation techniques: effects of formulation parameters," RSC Adv. 10:4218-4231.
Hewitt, E.W. (2003). "The MHC class I antigen presentation pathway: strategies for viral immune evasion," Immunology 110:163-169.
Hochstrasser, M.L. et al. (2014). "CasA mediates Cas3-catalyzed target degradation during CRISPR RNA-guided interference," PNAS 111:6618-6623.
Hu, S. et al. (2016). "Pseudotyping of lentiviral vector with novel vesiculovirus envelope glycoproteins derived from Chandipura and Piry viruses," Virology 488:162-168.
Huang, Z-M. et al. (1995). "Role of the hepatitis B virus post-transcriptional regulatory element in export of intronless transcripts," Mol. Cell. Biol. 15:3864-3869.
Huang, Z-M. et al. (1994) "Hepatitis B virus RNA element that facilitates accumulation of surface gene transcripts in the cytoplasm," J. Virol. 68:3193-3199.
Huang, J. et al. (1993). "A novel hepatitis B virus (HBV) genetic element with Rev response element-like properties that is essential for expression of HBV gene products," Mol. Cell. Biol 13:7476-7486.
International Search Report dated Apr. 30, 2020, for PCT Application No. PCT/US2019/061778, filed on Nov. 15, 2019, 6 pages.
International Search Report dated May 26, 2021, for PCT Application No. PCT/US2020/063488, filed on Dec. 4, 2020, 9 pages.
International Search Report dated Dec. 12, 2022, for PCT Application No. PCT/US2022/032579, filed on Jun. 7, 2022, 15 pages.
International Search Report dated Oct. 25, 2022, for PCT Application No. PCT/US2022/032577, filed on Jun. 7, 2022, 5 pages.
International Search Report dated Dec. 13, 2022, for PCT Application No. PCT/US2022/032578, filed on Jun. 7, 2022, 13 pages.
Izmiryan, A. et al. (2011). "Efficient gene targeting mediated by a lentiviral vector-associated meganuclease," Nucl. Acids Res. 39:7610-7619.
Jarmoskaite I. et al. (2019). "A quantitative and predictive model for RNA binding by human pumilio proteins," Mol. Cell. 74:966-981.
Johnson, L.G. et al. (2000). "Pseudotyped human lentiviral vector-mediated gene transfer to airway epithelia in vivo," Gene Therapy 7:568-574.
Johnston, J. et al. (1999). "Productive Infection of Human Peripheral Blood Mononuclear Cells by Feline Immunodeficiency Virus: Implications for Vector Development," J. Virol. 73:2491-2498.
Kaczmarczyk, S.J. et al. (2011). "Protein delivery using engineered virus-like particles," PNAS 108:16998-17003.
Kim, S. et al. (2014). "Highly efficient RNA-guided genome editing in human cells via delivery of purified Cas9 ribonucleoproteins," Genome Research 24:1012-1019.
Kotin, R. M. (1994). "Prospects for the use of adeno-associated virus as a vector for human gene therapy," Human Gene Therapy 5:793-801.
Kucik, D.F. et al. (1991). "Preferential Attachment of Membrane Glycoproteins to the Cytoskeleton at the Leading Edge of Lamella," J. Cell Biol. 114:1029-1036.
Lee, N.K. et al. (2021). "Impact of the conjugation of antibodies to the surfaces of polymer nanoparticles on the immune cell targeting abilities," Nano Convergence 8:24.
Lee, J.A. et al. (2005). "Lentiviral transfection with the PDGF-B gene improves diabetic wound healing," Plast. Reconstr. Surg. 116:532-538.
Lei, E. et al. (2002). "Protein and RNA Export from the Nucleus," Develop. Cell 2:261-272.
Levy, C. et al. (2017). "Measles virus envelope pseudotyped lentiviral vectors transduce quiescent human HSCs at an efficiency without precedent," Blood Advances 1:2088-2104.
Levy, C. et al. (2015). "Surface engineering of lentiviral vectors for gene transfer into gene therapy target cells," Curr. Opin. Pharmacol. 24:79-85.
Liang, X. et al. (2015). "Rapid and highly efficient mammalian cell engineering via Cas9 protein transfection," J. Biotechnol. 208:44-53.
Lin, S. et al. (2014). "Enhanced homology-directed human genome engineering by controlled timing of CRISPR/Cas9 delivery," eLife 3:e04766.
Liu, J-J. et al. (2019). "CasX enzymes compromise a distinct family of RNA-guided genome editors," Nature 566:218-223.
Liu, J-J. et al. (2019). CasX enzymes comprise a distinct family of RNA-guided genome editors, Nature 568:E8-E10.
Liu, T.Y. et al. (2020). "Chemistry of Class 1 CRISPR-Cas effectors: Binding, editing, and regulation," J. Biol. Chem. 295:14473-14487.
Liu, J. et al. (2014). "Cell-Penetrating Peptide-Mediated Delivery of TALEN Proteins via Bioconjugation for Genome Engineering," PLos One 9:e85755, 7 total pages.
Liu, J. et al. (2015). "Improved Cell-Penetrating Zinc-Finger Nuclease Proteins for Precision Genome Engineering," Mol. Ther. Nucl. Acids 4:e232, 9 total pages.
Lorenz R, et al. (2011). ViennaRNA Package 2.0. Algorithms Mol. Biol. 6:26.

(56) References Cited

OTHER PUBLICATIONS

Louis, J.M. et al. (1999). "Autoprocessing of HIV-1 protease is tightly coupled to protein folding," Nat. Struct. Mol. Biol. 6:868-875.
Makarova, K.S. et al. (2020). "Evolutionary classification of CRISPR-Cas systems: a burst of class 2 and derived variants," Nature Reviews Microbiology 18:67-83.
Mangeot, P.E. et al. (2017). "Efficient genome editing in primary cells and in vivo using viral-derived Nanoblades loaded with Cas9/sg RNA ribonucleoproteins," bioRxiv, located at www.biorxiv.org/content/10.1101/202010v1, 27 total pages.
Mangeot, P.E. et al. (2019). "Genome editing in primary cells and in vivo using viral-derived Nanoblades loaded with Cas9-sgRNA ribonucleoproteins," Nature Comm. 10:45, 15 total pages.
Mangeot, P.E. et al. (2011). "Protein Transfer into Human Cells by VSV-G-induced Nanovesicles," Mol. Ther. 19:1656-1666.
Markusic, D.M. et al. (2009). "Reduction of liver macrophage transduction by pseudotyping lentiviral vectors with a fusion envelope from *Autographa californica* GP64 and Sendai virus F2 domain," BMC Technology 9:85, 10 total pages.
Merten, O-W. et al. (2016). "Production of lentiviral vectors," Mol. Ther. Methods Clin. Dev. 3:16017.
Michel, G. et al. (2010). "Site-specific gene insertion mediated by a Cre-loxP—carrying lentiviral vector," Mol. Ther. 18:1814-1821.
Miyauchi, K. et al. (2012). "Therapeutic potential of HIV protease-activable CASP3," Scientific Reports 2:359.
Montagna, C. et al. (2018). "VSV-G-Enveloped Vesicles for Traceless Delivery of CRISPR-Cas9," Molecular Therapy: Nucleic Acids 12:453-462.
Muriaux, D. et al. (2010). "Properties and functions of the nucleocapsid protein in virus assembly," RNA Biology 7:6, pp. 744-753.
Noguchi, H. et al. (2003). "PDX-1 protein containing its own antennapedia-like protein transduction domain can transduce pancreatic duct and islet cells," Diabetes 52:1732-1737.
Partial Supplementary European Search Report dated Jul. 22, 2022, for EP Application No. 19 885 528.0, filed on Nov. 15, 2019, 16 pages.
Pfaller, C.K. et al. (2015). "Reverse genetics of Mononegavirales: How they work, new vaccines, and new cancer therapeutics," Virology 479:331-344.
Plemper, R.K. (2011). "Cell Entry of Enveloped Viruses," Curr. Opin. Virol. 1:92-100.
Pollard, V.W. et al. (1998). "The HIV-1 Rev protein," Ann. Rev. Microbiol. 52:491-532.
Polpitiya Arachchige, S. et al. (2019). "Analysis of herpes simplex type 1 gB, gD, and gH/gL on production of infectious HIV-1: HSV-1 gD restricts HIV-1 by exclusion of HIV-1 Env from maturing viral particles," Retrovirology 16:9.
Punfa, W. et al. (2012). "Enhancement of cellular uptake and cytotoxicity of curcumin-loaded PLGA nanoparticles by conjugation with anti-P-glycoprotein in drug resistance cancer cells," Acta Pharma. Sinica 33:823-831.
Pyzocha, N.K. et al. (2018). "Diverse Class 2 CRISPR-Cas Effector Proteins for Genome Engineering Applications," ACS Chemical Biology 13:347-356.
Qi, L.S. et al. (2013). "Repurposing CRISPR as an RNA-guided platform for sequence-specific control of gene expression," Cell 152:1173-1183.
Ramakrishna, S. et al. (2014). "Gene disruption by cell-penetrating peptide-mediated delivery of Cas9 protein and guide RNA," Genome Research 24:1020-1027.
Schumann, K. et al. (2015). "Generation of knock-in primary human T cells using Cas9 ribonucleoproteins," PNAS 112:10437-10442.
Selleck, W. et al. (2015). "Biophysical Characterization and Direct Delivery of S. Pyogenes Cas9 Ribonucleoprotein Complexes," Mol. Ther. 23:S66.
Shao, W. et al. (2018). "Inhibition of antigen presentation during AAV gene therapy using virus peptides," Human Molecular Genetics 27:601-613.
Shur, F. et al. (2015). "The Structure of Immature Virus-Like Rous Sarcoma Virus Gag Particles Reveals a Structural Role for the p10 Domain in Assembly," J Virol. 89:10294-10302.
Skipper, K.A. et al. (2015). "Delivering the goods for genome engineering and editing," Human Gene Therapy 26:486-497.
Smith, T.F. et al. (1981). "Comparison of biosequences," Adv. Appl. Math. 2:482-489.
Song. Y. (2019). "A new CRISPR scissor," Nature Chemical Biology 15:315.
Staahl, B.T. et al. (2017). "Efficient genome editing in the mouse brain by local delivery of engineered Cas9 ribonucleoprotein complexes," Nature Biotechnology 35:431-434.
Stevenson, M.E. et al. (2015). "Biotin- and Glycoprotein-Coated Microspheres as Surrogates for Studying Filtration Removal of *Cryptosporidium parvum* in a Granular Limestone Aquifer Medium," Applied Environ. Microbiol. 81:4277-4283.
Takimoto, T. et al. (2004). "Molecular mechanism of paramyxovirus budding," Virus Res. 106:133-145.
Tang, Y. et al. (2018). "Class 2 CRISPR/Cas: an expanding biotechnology toolbox for and beyond genome editing," Cell Biosci. 8:59.
Tréhin, R. et al. (Jul. 2004). "Cellular uptake but low permeation of human calcitonin-derived cell penetrating peptides and Tat(47-57) through well-differentiated epithelial models," Pharm. Res. 21:1248-1256.
Van der Oost, J. et al. (2014). "Unravelling the structural and mechanistic basis of CRISPR-Cas systems," Nat. Rev. Microbiol. 12:479-492.
Verhoeyen, E. et al. (2004). "Surface-engineering of lentiviral vectors," J. Gene Med. 6:S83-S94.
Vindry, C. et al. (2019). "A Versatile Strategy to Reduce UGA-Selenocysteine Recoding Efficiency of the Ribosome Using CRISPR-Cas9-Viral-Like-Particles Targeting Selenocysteine-tRNA$^{[Ser]Sec}$ Gene," Cells 8:574.
Voelkel, C. et al. (2010). "Protein transduction from retroviral Gag precursors," PNAS 107:7805-7810.
Watson, D.J. et al. (2002). "Targeted Transduction Patterns in the Mouse Brain by Lentivirus Vectors Pseudotyped with VSV, Ebola, Mokola, LCMV, or MuLV Envelope Proteins," Mol. Ther. 5:528-537.
Wender, P.A. et al. (Nov. 2000). "The design, synthesis, and evaluation of molecules that enable or enhance cellular uptake: peptoid molecular transporters," PNAS 97:13003-13008.
Wittig, S. et al. (2020). "Formation and Stoichiometry of CRISPR-Cascade Complexes with Varying Spacer Lengths Revealed by Native Mass Spectrometry," J. Am. Soc. Mass Spectrom. 31:538-546.
Wong, L-F. et al. (2004). "Transduction Patterns of Pseudotyped Lentiviral Vectors in the Nervous System," Mol. Ther. 9:101-111.
Wright, A.V. et al. (2016). "Biology and Applications of CRISPR Systems: Harnessing Nature's Toolbox for Genome Engineering," Cell 164:29-44.
Written Opinion of the International Searching Authority dated Apr. 30, 2020, for PCT Application No. PCT/US2019/061778, filed on Nov. 15, 2019, 9 pages.
Written Opinion of the International Searching Authority dated May 26, 2021, for PCT Application No. PCT/US2020/063488, filed on Dec. 4, 2020, 8 pages.
Written Opinion of the International Searching Authority dated Dec. 12, 2022, for PCT Application No. PCT/US2022/032579, filed on Jun. 7, 2022, 21 pages.
Written Opinion of the International Searching Authority dated Oct. 25, 2022, for PCT Application No. PCT/US2022/032577, filed on Jun. 7, 2022, 6 pages.
Written Opinion of the International Searching Authority dated Dec. 13, 2022, for PCT Application No. PCT/US2022/032578, filed on Jun. 7, 2022, 21 pages.
Xiao, Q. et al. (2019). "Application of CRISPR/Cas9-based gene editing in HIV-1/AIDS therapy," Front. Cell. Infect. Microbiol. 9:69.
Xu, D., et al. (2012). "NESdb: a database of NES-containing CRM1 cargoes," Mol. Biol. Cell. 23:3673-3676.

(56) References Cited

OTHER PUBLICATIONS

Yang, G. et al. (2013). "Viral infectivity factor: a novel therapeutic strategy to block HIV-I replication," Minireview Med. Chem. 13:1047-1055.

Yang, H. et al. (May 2019). "CasX: a new and small CRISPR gene-editing protein," Cell Res. 29:345-346. Published online Apr. 16, 2019.

Yewdell, J.W. et al. (1999). "Mechanisms of Viral Interference with MHC Class I Antigen Processing and Presentation," Annu. Rev. Cell Dev. Biol. 15:579-606.

Yip, B.H. (2020). "Recent Advances in CRISPR/Cas9 Delivery Strategies," Biomolecules 10:839.

Zeldis, J.B. et al. (1986). "In Vitro Hepatitis B Virus Infection of Human Bone Marrow Cells," J. Clin. Invest. 78:411-417.

Zender, L. et al. (2002). "VP22-mediated intercellular transport of p53 in hepatoma cells in vitro and in vivo," Cancer Gene Ther. 9:489-496.

Zetsche, B. et al. (2015). "Cpf1 Is a Single RNA-Guided Endonuclease of a Class 2 CRISPR-Cas System," Cell 163:759-771.

Zhang, J. et al. (1997). "PowerBLAST: a new network BLAST application for interactive or automated sequence analysis and annotation," Genome Res. 7:649-656.

Zhao, R.Y. et al. (2014). "HIV-1 accessory proteins: VpR," Methods Mol. Biol. 1087:125-134.

Zhao, Y. et al. (2008). "Characterization of Complete Particles (VSV-G/SIN-GFP) and Empty Particles (VSV-G/EMPTY) in Human Immunodeficiency Virus Type 1-Based Lentiviral Products for Gene Therapy: Potential Applications for Improvement of Product Quality and Safety," Human Gene Therapy 19:475-486.

Zucchelli, E. et al. (2017). "Codon optimization leads to functional impairment of RD114-TR envelope glycoprotein," Molecular Therapy: Methods & Clinical Development 4:102-114 (with Supplemental Information).

Zuris, J.A. et al. (2015). "Efficient Delivery of Genome-Editing Proteins In Vitro and In Vivo," Nat. Biotechnol. 33:73-80.

Zuris, J.A. et al. (2015). "Cationic lipid-mediated delivery of proteins enables efficient protein-based genome editing in vitro and in vivo," Nature Biotechnol. 33:73-80.

U.S. Appl. No. 18/058,251, by Benjamin Oakes et al., filed Nov. 22, 2022 (Copy not attached).

U.S. Appl. No. 17/791,130, by Benjamin Oakes et al., filed Jan. 8, 2021 (Copy not attached).

U.S. Appl. No. 18/051,815, by Benjamin Oakes et al., filed Nov. 1, 2022 (Copy not attached).

U.S. Appl. No. 17/828,957, by Benjamin Oakes et al., filed Dec. 4, 2020 (Copy not attached).

U.S. Appl. No. 18/193,571, by Benjamin Oakes et al., filed Mar. 30, 2023 (Copy not attached).

U.S. Appl. No. 17/932,798, by Benjamin Oakes et al., filed Mar. 17, 2021 (Copy not attached).

Albarino, C.G. et al. (2015). "Development of a reverse genetics system to generate a recombinant ebola virus Makona expressing a green fluorescent protein," Virology 484:259-264.

Kang, Y-L. et al. (2020). "Inhibition of PIKfyve kinase prevents infection by Zaire ebolavirus and SARS-Cov-2," PNAS 117:20803-20813.

Lo, M. et al. (2014). "Evaluation of luciferase and GFP-expressing Nipah viruses for rapid quantitative antiviral screening," Antiviral Res. 106:53-60, 16 pages provided.

Wang, Y.E. et al. (2010). "Ubiquitin-regulated nuclear-cytoplasmic trafficking of the Nipah virus matrix protein is important for viral budding," PLOS Pathogens 6:e1001186, 17 pages provided.

Wolf, M.C. et al. (2010). "A broad-spectrum antiviral targeting entry of enveloped viruses," PNAS 107:3157-3162.

U.S. Appl. No. 18/466,636, by Benjamin Oakes et al., filed Sep. 13, 2023 (Copy not attached).

U.S. Appl. No. 18/039,858, by Gayathri Vijayakumar et al., filed Jun. 1, 2023 (Copy not attached).

U.S. Appl. No. 18/568,029, by Benjamin Oakes et al., filed Dec. 7, 2023 (Copy not attached).

* cited by examiner

Table 10: SEQ ID NOs for DNA encoding sequences of XDP components

| Virus | DNA Sequences for Components | | | | | |
|---|---|---|---|---|---|---|
| | Matrix | P2A-P2B-P10-PP24 | Capsid | Nucleocapsid | Protease | - |
| ALV | 797 | 798 | 799 | 800 | 801 | - |
| RSV | 802 | 803 | 804 | 805 | 806 | - |
| | Matrix | PP21/24 | P3-P8/P12 | Capsid | Nucleocapsid | Protease |
| ENTV | 807 | 808 | | 809 | 810 | 811 |
| MMTV | 812 | 813 | 814 | 815 | 816 | 817 |
| MPMV | 818 | 819 | 820 | 821 | 822 | 823 |
| MPMV Native | 824 | 825 | 826 | 827 | 828 | 829 |
| | Matrix | Capsid | Nucleocapsid | Protease | Ma-Ca-Cleave Site | Capsid First 18 |
| BLV | 830 | 831 | 832 | 833 | 834 | 835 |
| HTLV1 | 836 | 837 | 838 | 839 | 840 | 841 |
| HTLV1 Native | 842 | 843 | 844 | 845 | 846 | 847 |
| | Matrix | P20 | Capsid | Nucleocapsid | Protease | Ma-Ca-Cleave Site |
| WDSV | 848 | 849 | 850 | 851 | 852 | 853 |
| | Matrix | P12 | Capsid | Nucleocapsid | Protease | Ma-Ca-Cleave Site |
| FLV | 854 | 855 | 856 | 857 | 858 | 859 |
| MMLV | 860 | 861 | 862 | 863 | 864 | 865 |
| | Matrix | Capsid | Nucleocapsid | Protease | Ma-Ca-Cleave Site | Capsid First 18 |
| CEAV | 866 | 867 | 868 | 869 | 870 | 871 |
| EIAV | 872 | 873 | 874 | 875 | 876 | 877 |
| SIV | 878 | 879 | 880 | 881 | 882 | 883 |
| SIV Native | 884 | 885 | 886 | 887 | 888 | 889 |
| VMV | 890 | 891 | 892 | 893 | 894 | 895 |
| | Gag | Protease | Cleavage Site | - | - | - |
| BFV | 896 | 897 | 898 | - | - | - |
| BGPFV | 899 | 900 | 901 | - | - | - |
| CCFV | 902 | 903 | 904 | - | - | - |
| EFV | 905 | 906 | 907 | - | - | - |
| FFV | 908 | 909 | 910 | - | - | - |
| RHSFV | 911 | 912 | 913 | - | - | - |
| SFV | 914 | 915 | 916 | - | - | - |
| | Matrix | Capsid | P2 | NC | P1 | P6 | |
| HIV-1 | 917 | 918 | 919 | 920 | 921 | 922 | |
| | Matrix | Capsid | P2 | NC | P1 | P6 | Protease |
| HIV-1 Gag-TFR-PR | 1859 | 1860 | 1861 | 1862 | 1863 | 1864 | 1865 |

PARTICLE DELIVERY SYSTEMS

CROSS REFERENCE TO RELATED APPLICATIONS

This application is a bypass continuation of International Application No. PCT/US2022/032579, filed on Jun. 7, 2022, which claims priority to U.S. provisional patent application No. 63/208,932, filed on Jun. 9, 2021, and 63/285,420, filed on Dec. 2, 2021, the contents of each of which are incorporated herein by reference in their entireties.

INCORPORATION BY REFERENCE OF SEQUENCE LISTING

The contents of the electronic sequence listing (SCRB_032_03US_SeqList_ST26.xml; Size: 35,633,030 bytes; and Date of Creation: Jan. 31, 2023) are herein incorporated by reference in its entirety.

BACKGROUND

The delivery of protein or nucleic acid therapeutics to particular cells or organs of the body generally requires complex systems in which a targeting modality or vehicle is linked to or contains the therapeutic nucleic acid and/or protein. Even with highly selective targeting modalities, such as monoclonal antibodies, the selectivity of the system for the target cells or organs is not absolute, and off-target toxicity can be a consequence.

The Retroviridae family of viruses encompass several genera of viruses that cause chronic and deadly diseases characterized by long incubation periods, in humans and other mammalian species. The Retroviridae family includes Othoretrovirinae (Lentivirus, Alpharetrovirus, Betaretrovirus, Deltaretrovirus, Epsilonretrovirus, Gammaretrovirus), and Spumaretrovirinae. The best-known lentivirus is the Human Immunodeficiency Virus (HIV), which causes acquired immune deficiency syndrome (AIDS). As with all retroviruses, lentiviruses have gag, pol and env genes, coding for viral proteins in the order: 5'-Gag-pol-env-3'. The lentivirus system has been adapted to introduce gene editing systems into human or animal cells by the creation of virus-like particles (VLP) containing the gene editing systems. Retroviral systems have advantages over other gene-therapy methods, including high-efficiency infection of dividing and non-dividing cells, long-term stable expression of a transgene, and low immunogenicity. Lentiviruses have been successfully used for transduction of diabetic mice with the gene encoding PDGF (platelet-derived growth factor), a therapy being considered for use in humans (Lee J A, et al. Lentiviral transfection with the PDGF-B gene improves diabetic wound healing. Plast. Reconstr. Surg. 116 (2): 532 (2005)). However, one major difficulty with use of certain therapeutics, like CRISPR nucleases, in VLP is off-target effects, particularly with long-term expression of the nuclease when traditional expression methods, such as via plasmid or viral vectors, are used. Accordingly, there remains a need for improved systems for delivery of gene editing systems using particles derived from viral vectors.

SUMMARY

The present disclosure provides delivery particle (XDP) systems for the delivery of therapeutic payloads, including proteins, nucleic acids, small molecules, or combinations thereof, to target cells and tissues.

In some embodiments, the XDP system comprises components selected from Retroviridae viral proteins, a therapeutic payload, and one or more tropism factors wherein the tropism factor (located on the surface of the particle) is a glycoprotein, an antibody fragment, a receptor, a ligand to a target cell receptor, or combinations thereof. In some embodiments, the therapeutic payload can be a protein, a nucleic acid, or both a protein and a nucleic acid. In some embodiments of the XDP system, the protein payload is selected from the group consisting of a cytokine, an interleukin, an enzyme, a receptor, a microprotein, a hormone, erythropoietin, a ribonuclease (RNAse), a deoxyribonuclease (DNAse), a blood clotting factor, an anticoagulant, granulocyte-macrophage colony-stimulating factor (GMCSF), a bone morphogenetic protein, an engineered protein scaffold, a thrombolytic protein, a CRISPR protein, a transcription factor, a transposon, reverse transcriptase, viral interferon antagonists, a tick protein, and an anti-cancer modality. In one embodiment, the therapeutic payload is a Class 2 CRISPR protein, wherein the Class 2 CRISPR protein selected from the group consisting of a Type II, Type V, or Type VI protein. In some embodiments, the Class 2 CRISPR Type V protein is selected from the group consisting of Cas12a (Cpf1), Cas12b (C2c1), Cas12c (C2c3), Cas12d (CasY), Cas12e (CasX), Cas12f, Cas12g, Cas12h, Cas12i, Cas12j, Cas12k, Cas14, and CasΦ, or variants or derivatives thereof. In some embodiments, the therapeutic payload of the XDP is a nucleic acid selected from the group consisting of a single-stranded antisense oligonucleotide (ASO), a double-stranded RNA interference (RNAi) molecule, a DNA aptamer, an RNA aptamer, and a CRISPR guide ribonucleic acid (gRNA), or any combination thereof. In some embodiments, the therapeutic payload of the XDP is the CRISPR gRNA from a Class 2 system. In some embodiments, the CRISPR guide nucleic acid is a single-molecule guide RNA comprising a scaffold sequence and a targeting sequence capable of binding a target nucleic acid sequence. In some embodiments, the therapeutic payload of the XDP is a ribonucleoprotein (RNP) of the CRISPR protein complexed with the gRNA. In a particular embodiment, the therapeutic payload comprises a CasX variant and a guide RNA variant complexed as an RNP; optionally, a donor template is also encapsidated in the XDP.

In another aspect, the present disclosure provides nucleic acids encoding the components of the XDP system, as well as vectors and plasmids comprising the nucleic acids. In some embodiments, the components of the XDP system are encoded on two nucleic acids, on three nucleic acids, on four nucleic acids, or on five nucleic acids. In some embodiments, the XDP system comprises nucleic acids encoding one or more retroviral components selected from the group consisting of one or more protease cleavage sites, a Gag-transframe region-protease polyprotein (Gag-TFR-PR), a retroviral Gag polyprotein, a retroviral Gag-pol polyprotein, and a protease capable of cleaving the protease cleavage sites. In some embodiments, the retroviral components of the XDP system are derived from an Orthoretrovirinae virus or a Spumaretrovirinae virus wherein the Orthoretrovirinae virus is selected from the group consisting of Alpharetrovirus, Betaretrovirus, Deltaretrovirus, Epsilonretrovirus, Gammaretrovirus, and Lentivirus, and the Spumaretrovirinae virus is selected from the group consisting of Bovispumavirus, Equispumavirus, Felispumavirus, Prosimiispumavirus, Simiispumavirus, and Spumavirus. In some embodiments, the XDP system comprises nucleic acids encoding the therapeutic payload and tropism factor(s).

In some embodiments, the components of the XDP system are capable of self-assembling into an XDP when the one or more nucleic acids encoding the components of the XDP are introduced into a eukaryotic host packaging cell and are expressed. In the foregoing embodiments, the therapeutic payload is encapsidated within the XDP upon self-assembly of the XDP. In some embodiments, the tropism factor is incorporated in the XDP surface upon self-assembly of the XDP.

In other aspects, the present disclosure provides methods of making an XDP comprising a therapeutic payload. In some embodiments, the method comprises propagating the packaging host cell transfected with the encoding vectors of any of the embodiments described herein under conditions such that XDPs are produced, and harvesting the XDPs produced by the packaging host cell. The present disclosure further provides XDP produced by the foregoing methods.

In other aspects, the present disclosure provides a method of modifying a target nucleic acid sequence in a cell, the method comprising contacting the cell with the XDP comprising an RNP of any of the embodiments disclosed herein, wherein said contacting comprises introducing into the cell the RNP comprising the CRISPR Class 2 nuclease protein, the guide RNA comprising a targeting sequence capable of binding the target nucleic acid, and, optionally, the donor template nucleic acid sequence, resulting in modification of the target nucleic acid sequence. In one embodiment, the cell is modified in vitro or ex vivo. In another embodiment, the cell is modified in vivo. In the foregoing embodiment, the XDP is administered to a subject at a therapeutically effective dose, wherein the subject is the subject is selected from the group consisting of mouse, rat, pig, non-human primate, and human.

In another aspect, provided herein are XDP particle compositions. In some embodiments, the XDP compositions are for use as a medicament for the treatment of a subject having a disease.

In another aspect, provided herein are compositions for use in the treatment of a subject having a disease, the compositions comprising the XDP of any of the embodiments described herein.

INCORPORATION BY REFERENCE

All publications, patents, and patent applications mentioned in this specification are herein incorporated by reference to the same extent as if each individual publication, patent, or patent application was specifically and individually indicated to be incorporated by reference. The contents of WO 2020/247882, filed on Jun. 5, 2020, WO 2020/247883, filed Jun. 5, 2020, WO 2021/050593, filed on Sep. 9, 2020, WO 2021/050601, filed on Sep. 9, 2020, WO 2021/142342, filed on Jan. 8, 2021, WO 2021/113763, filed on Dec. 4, 2020, WO 2021/113769, filed on Dec. 4, 2020, WO 2021/113772, filed on Dec. 4, 2020, and PCT/US2021/061673, filed Dec. 2, 2021, which disclose CasX variants and gRNA variants, are hereby incorporated by reference in their entirety.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

Figure 48:
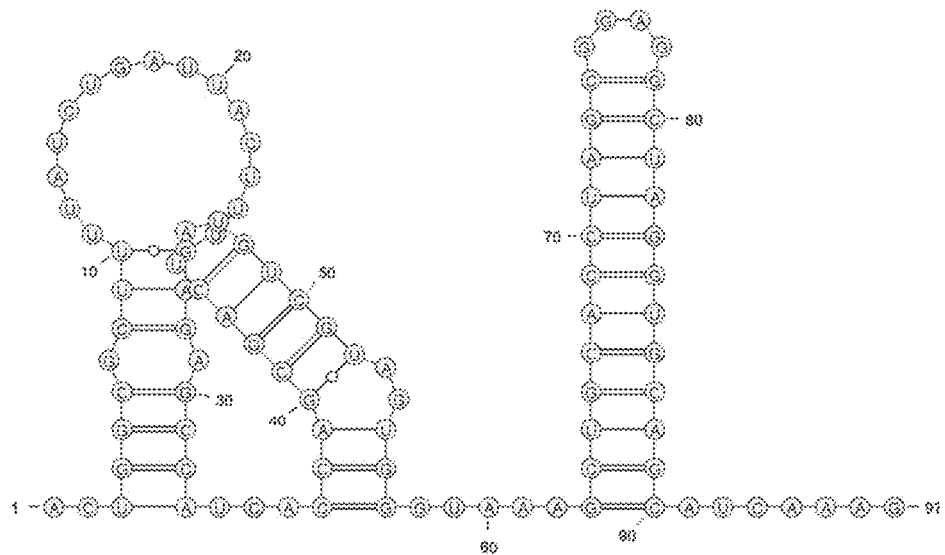

FIG. 48 is a schematic of the two-dimensional structure of guide scaffold 243 with stemloop 3 of an RRE, as described in Example 19. The sequence in FIG. 48 is SEQ ID NO: 2300.

Figure 49:
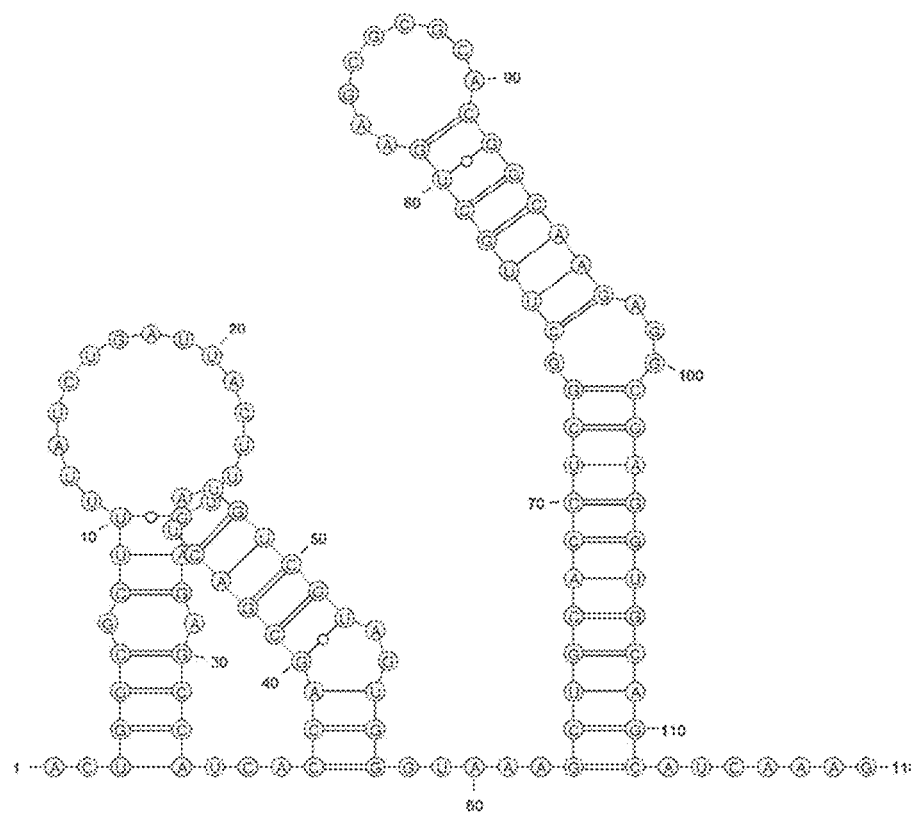

FIG. 49 is a schematic of the two-dimensional structure of guide scaffold 243 with stemloop 1 of an RRE, as described in Example 19. The sequence in FIG. 49 is SEQ ID NO: 2301.

Figure 50:
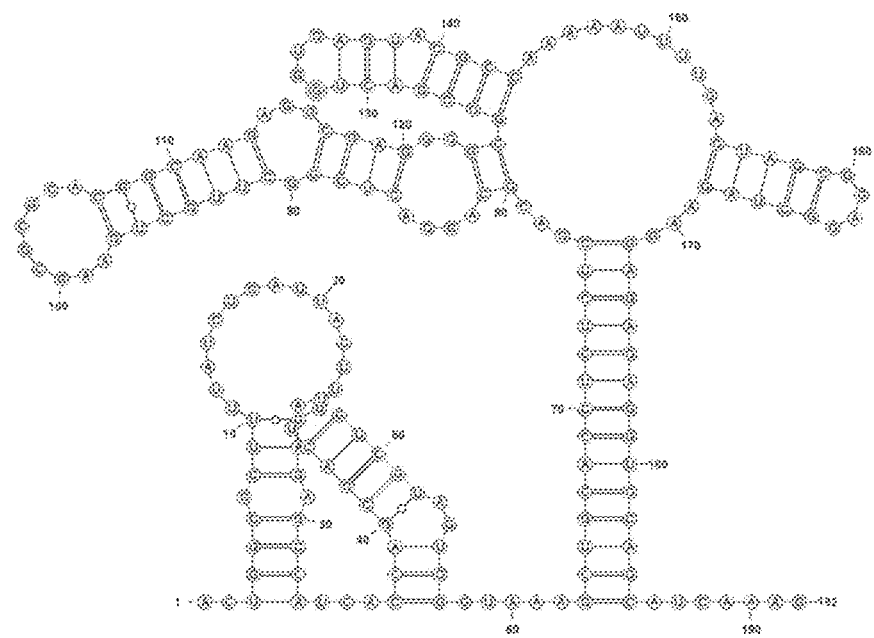

FIG. 50 is a schematic of the two-dimensional structure of guide scaffold 245 with full Psi without stem loop 4, as described in Example 19. The sequence shown in FIG. 50 is SEQ ID NO: 2302.

Figure 51:
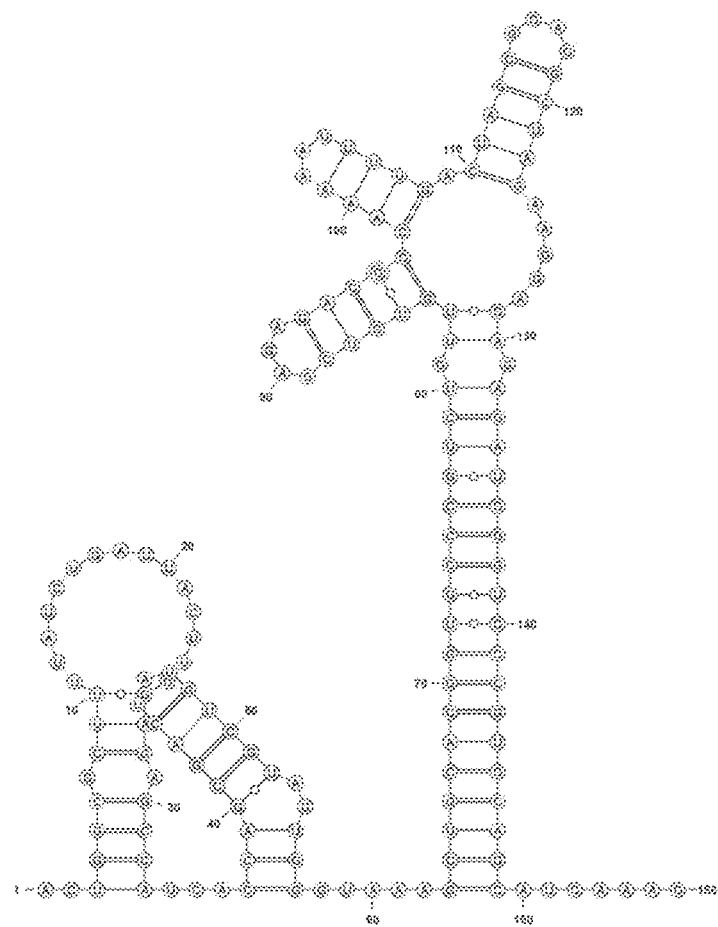

FIG. 51 is a schematic of the two-dimensional structure of guide scaffold 246 with Psi 3 way junction, as described in Example 19. The sequence shown in FIG. 51 is SEQ ID NO: 2303.

Figure 52:
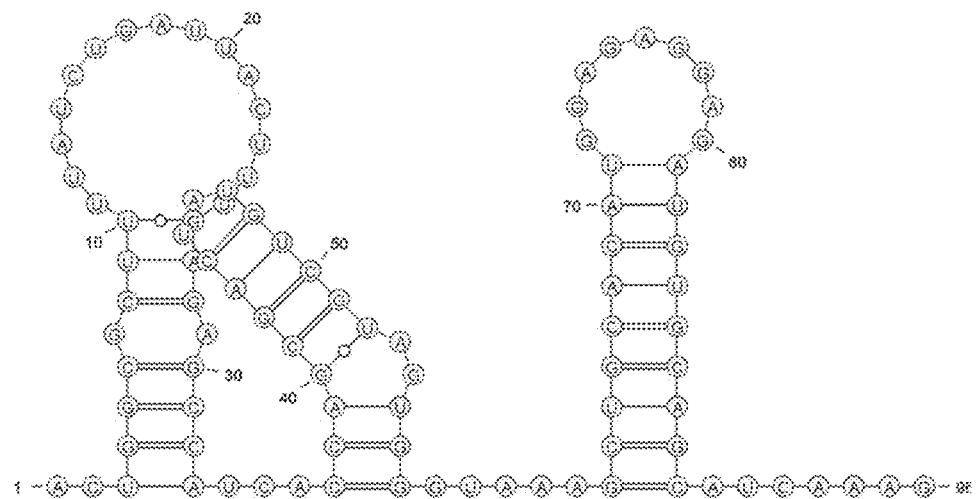

FIG. 52 is a schematic of the two-dimensional structure of guide scaffold 247 with 2 GGAG elements, as described in Example 19. The sequence shown in FIG. 52 is SEQ ID NO: 2304.

Figure 53:
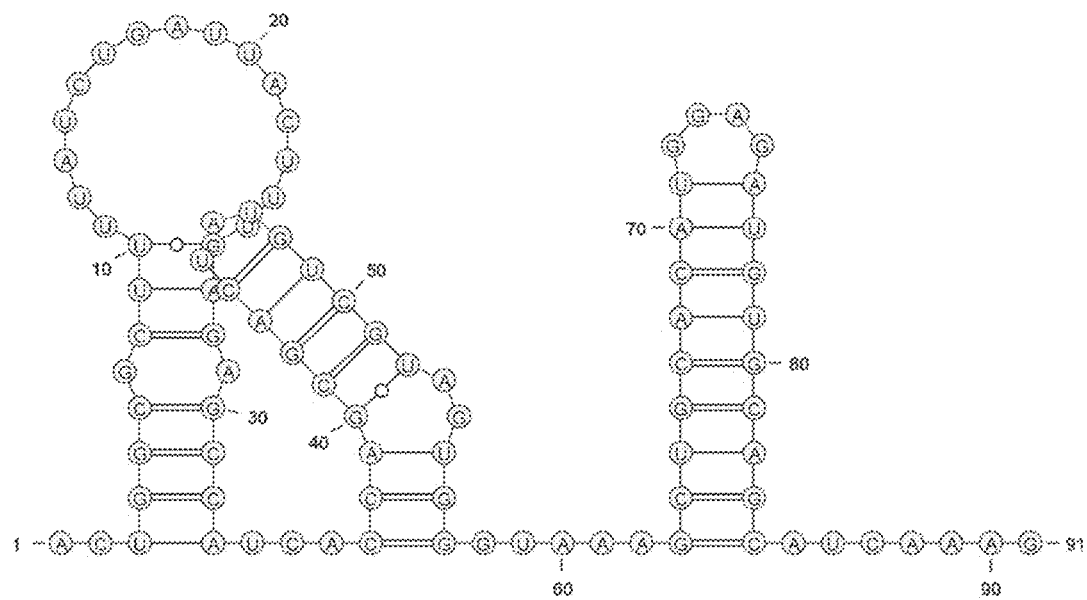

FIG. 53 is a schematic of the two-dimensional structure of guide scaffold 248 with 1 GGAG element, as described in Example 19. The sequence shown in FIG. 53 is SEQ ID NO: 2305.

Figure 54:
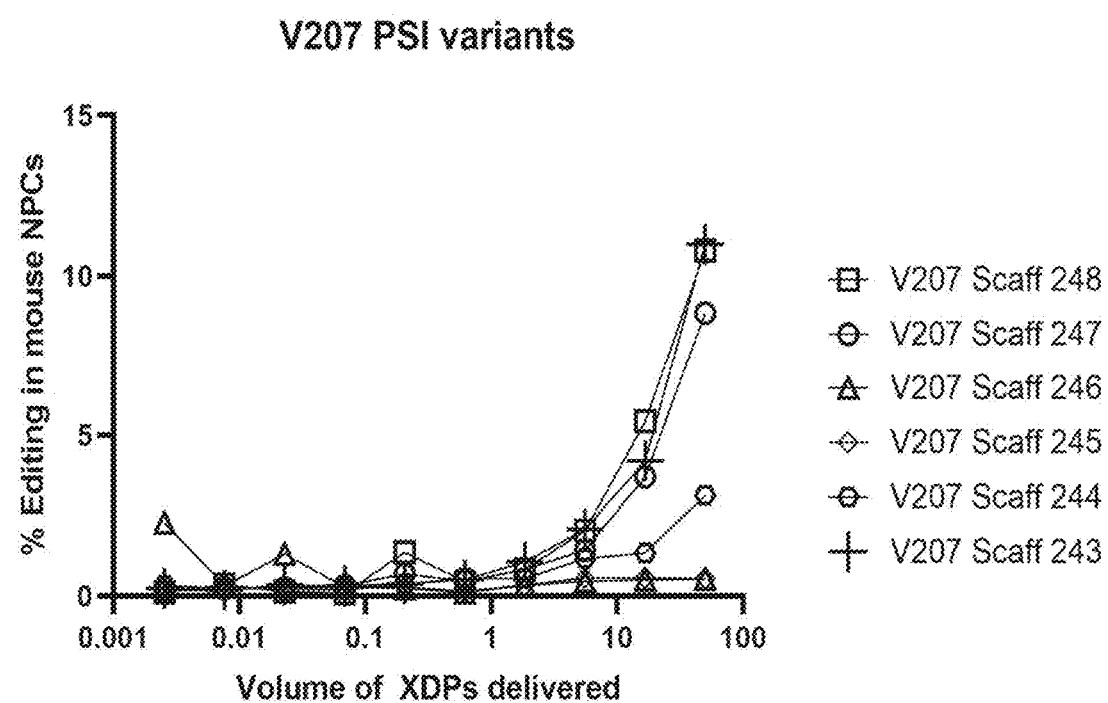

FIG. 54 is a graph of editing results with XDP Version 207 and guide scaffold variants, as described in Example 19.

Figure 55:
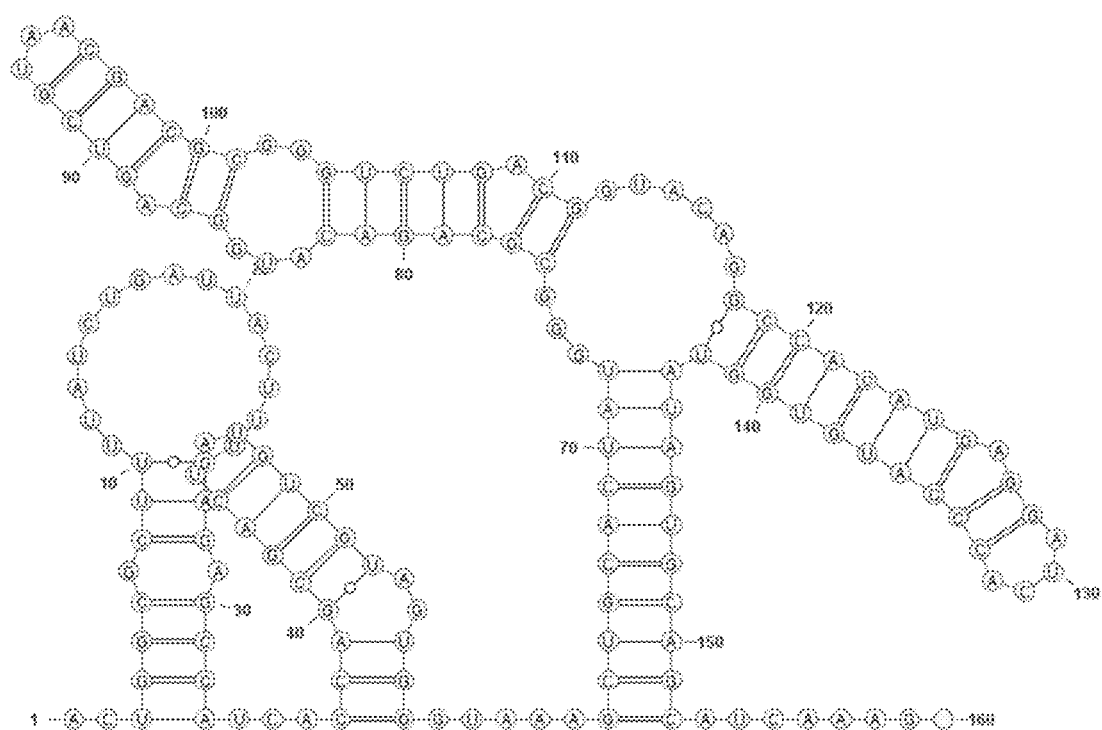

FIG. 55 is a schematic of the two-dimensional structure of guide scaffold 254 with an MS2 binding hairpin on the right of the extended stem and an RBE on the left of the stem, as described in Example 20, Example 25, and Example 27. The sequence shown in FIG. 55 is SEQ ID NO: 2311.

Figure 56:
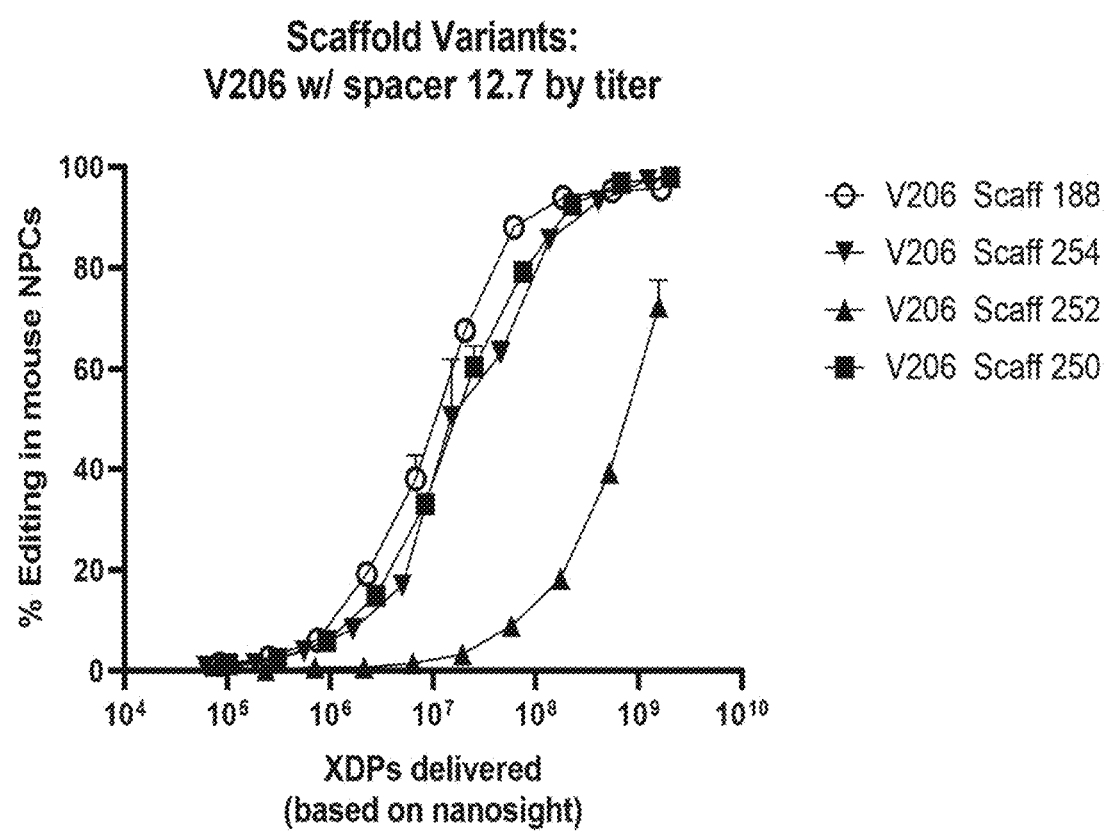

FIG. 56 is a graph of editing results with XDP Version 206 with three guide variants with MS2 hairpins or RBE and control guide scaffold 188 with editing percent plotted against the number of particles of XDP delivered, as described in Example 20.

Figure 57:
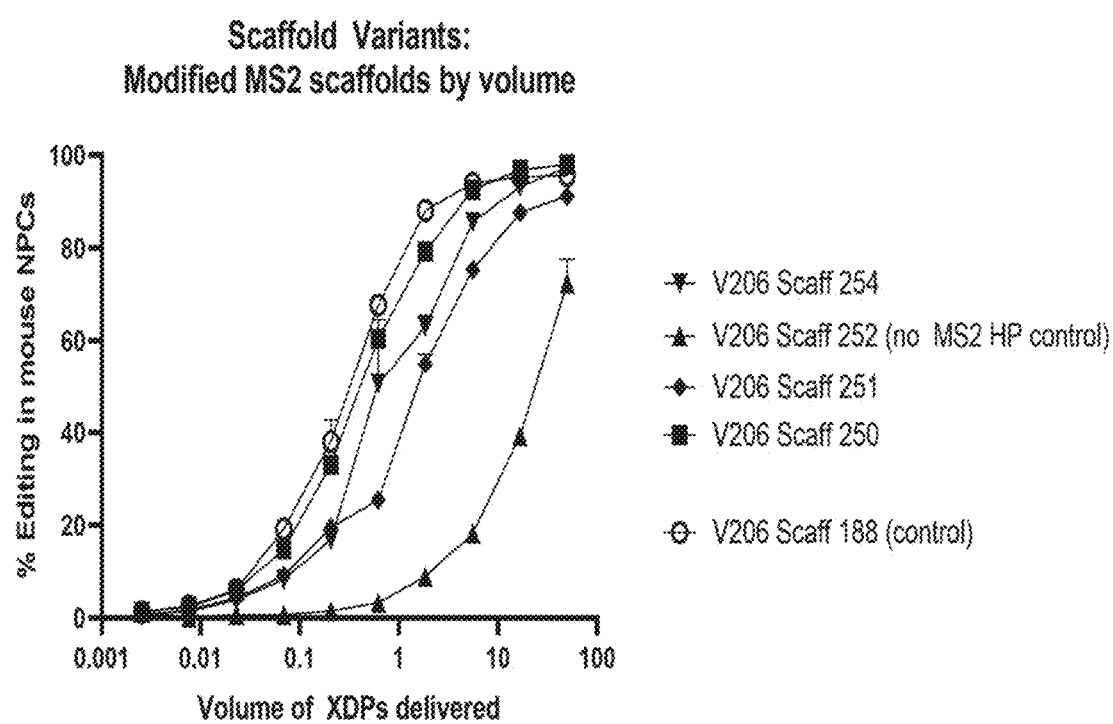

FIG. 57 is a graph of editing results with XDP Version 206 with four guide variants with MS2 hairpins or RBE and control guide scaffold 188, with editing percent plotted against the volume of XDP delivered, as described in Example 20.

Figure 58:
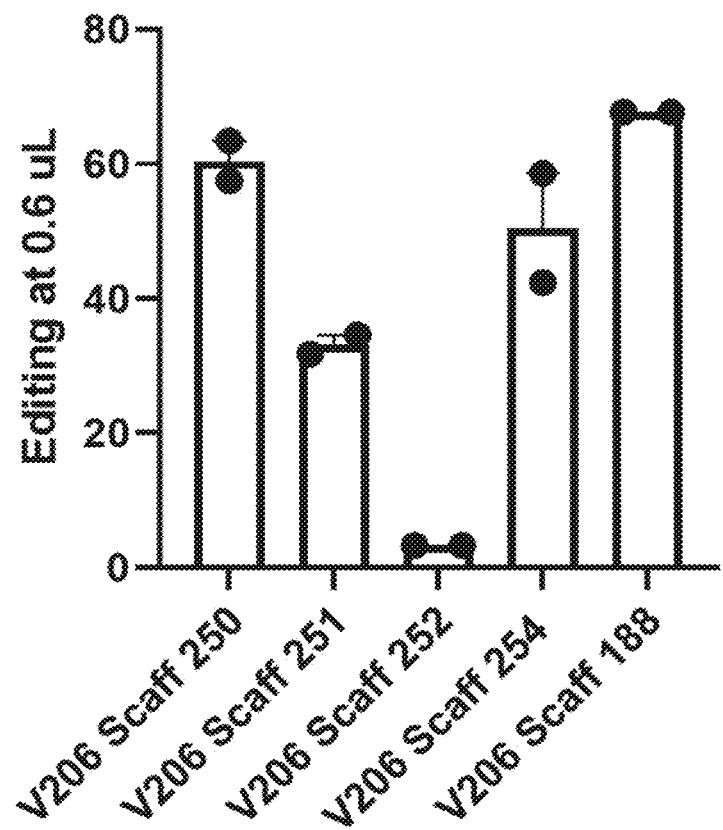

FIG. 58 is a bar chart of editing results with XDP Version 206 with four guide variants with MS2 hairpins or RBE and control guide scaffold 188, with editing percent achieved using the indicated volume of XDP delivered, as described in Example 20.

Figure 59:
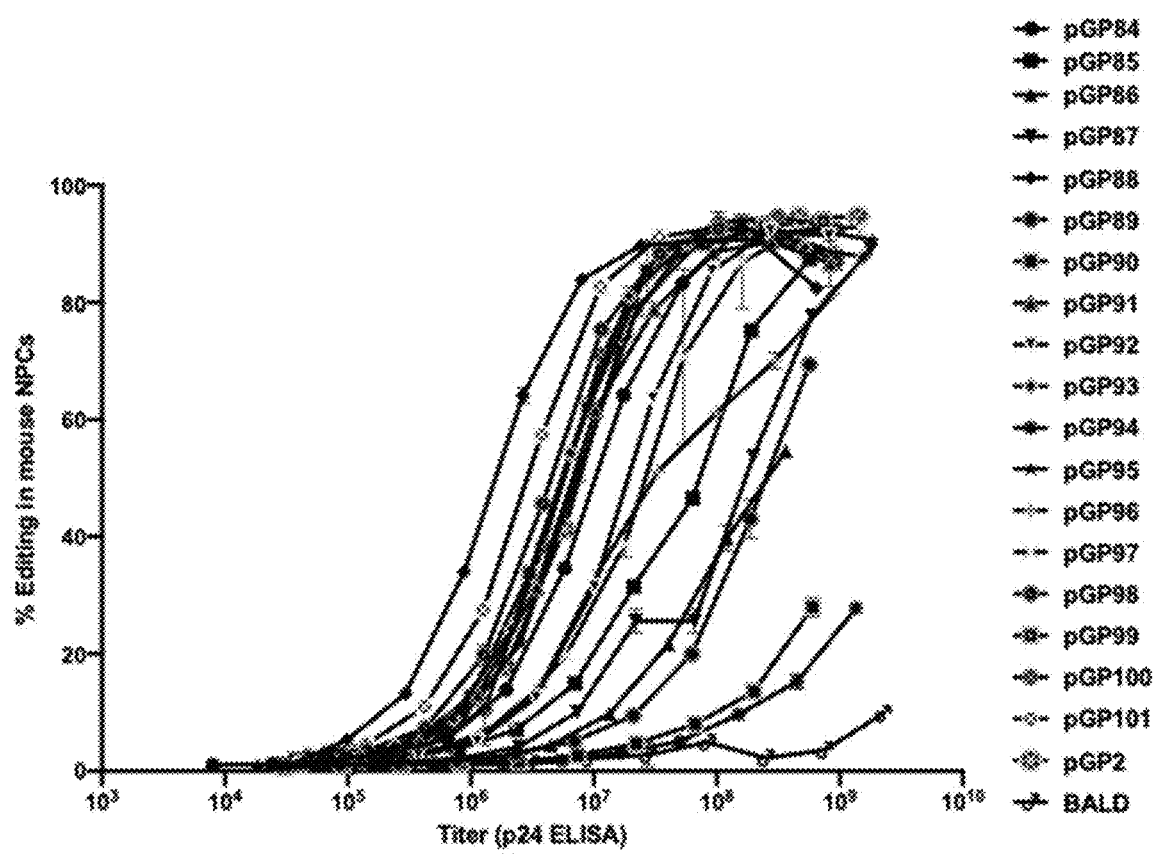

FIG. 59 is a graph of editing results with XDP constructs having various incorporated glycoproteins (or a bald negative control without an incorporated glycoprotein) used to edit tdTomato in NPCs in terms of number of particles added to treat the cells, as described in Example 21.

Figure 60:
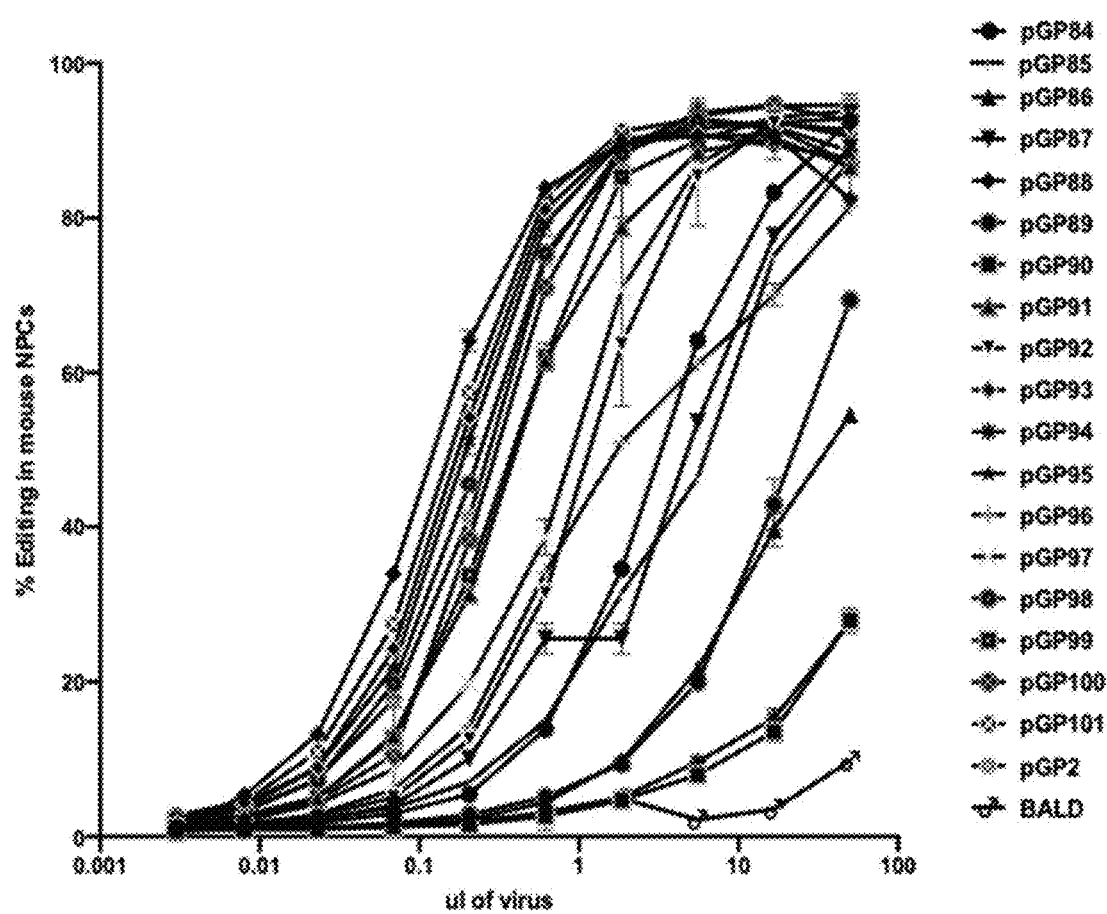

FIG. 60 is a graph of editing results with XDP constructs having various incorporated glycoproteins (or a bald negative control) used to edit tdTomato in NPCs in terms of volume of XDP added to treat the cells, as described in Example 21.

Figure 61:
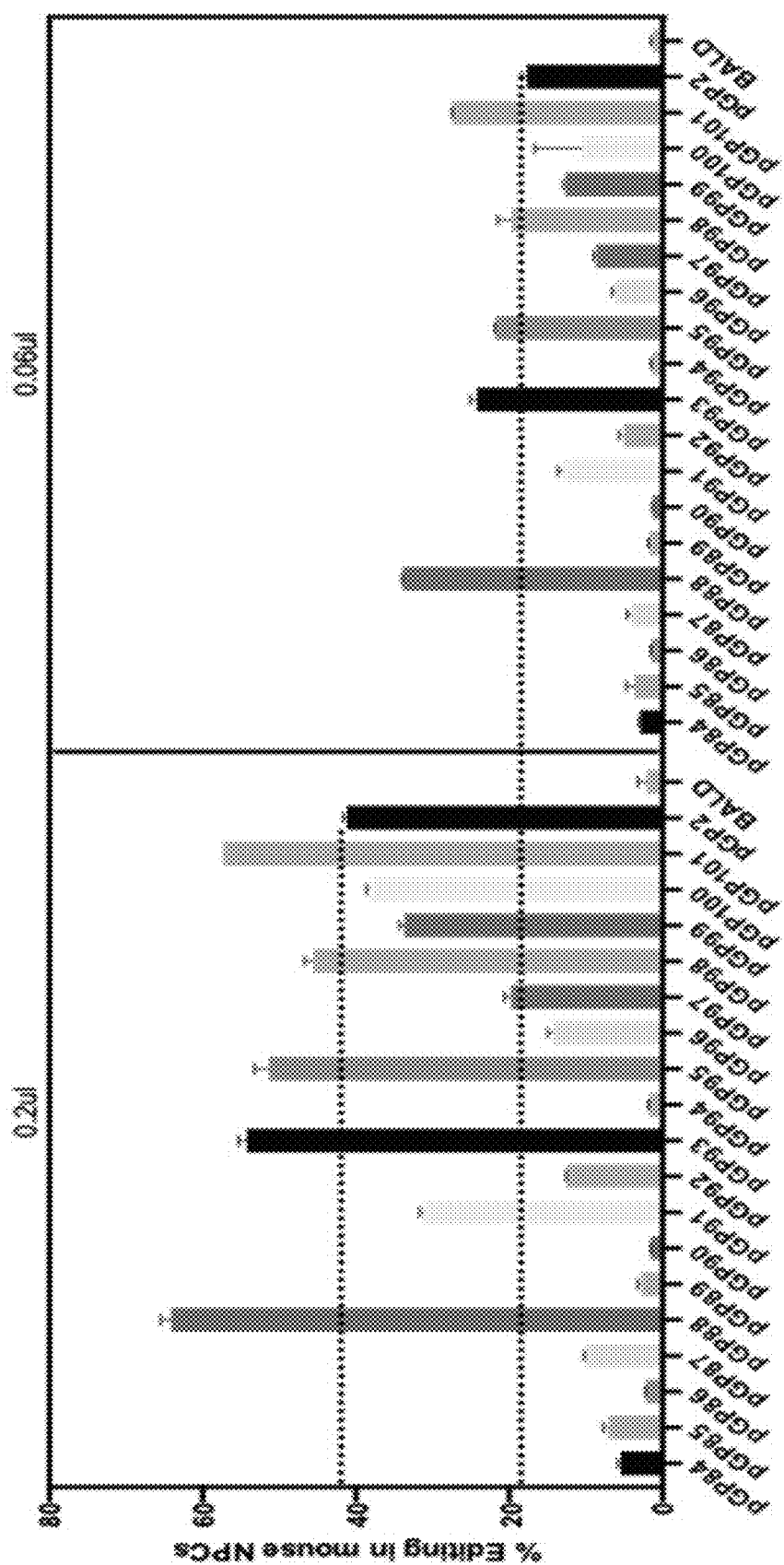

FIG. 61 is a graph of editing results with XDP constructs having various incorporated glycoproteins (or a bald negative control) used to edit tdTomato in NPCs using 2 different volumes of XDP added to treat the cells, as described in Example 21.

Figure 62:
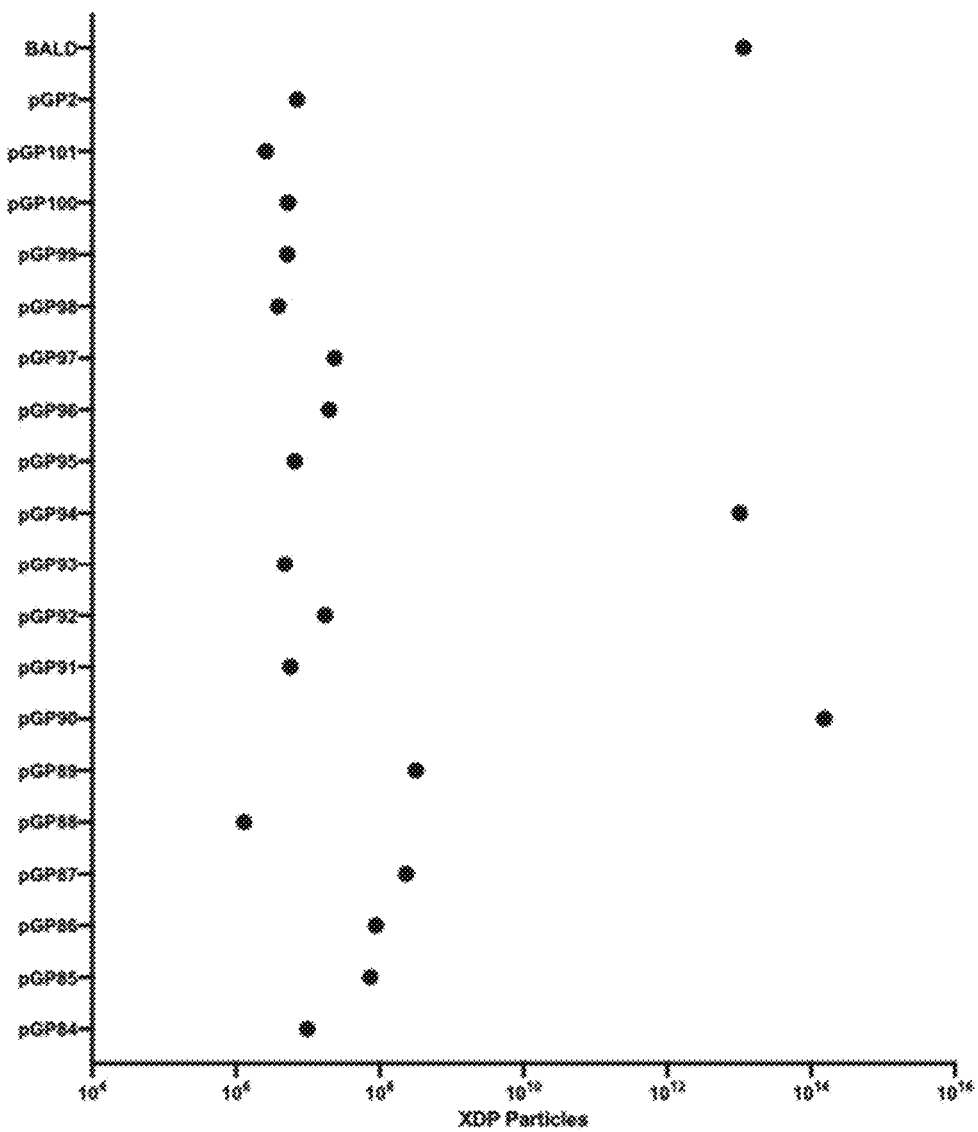

FIG. 62 is a scatterplot of EC50 values for editing results with XDP constructs having various incorporated glycoproteins (or a bald negative control) used to edit tdTomato in NPCs, as described in Example 21. The EC50 for the different constructs was determined using P24 ELISA-based titers.

Figure 63:
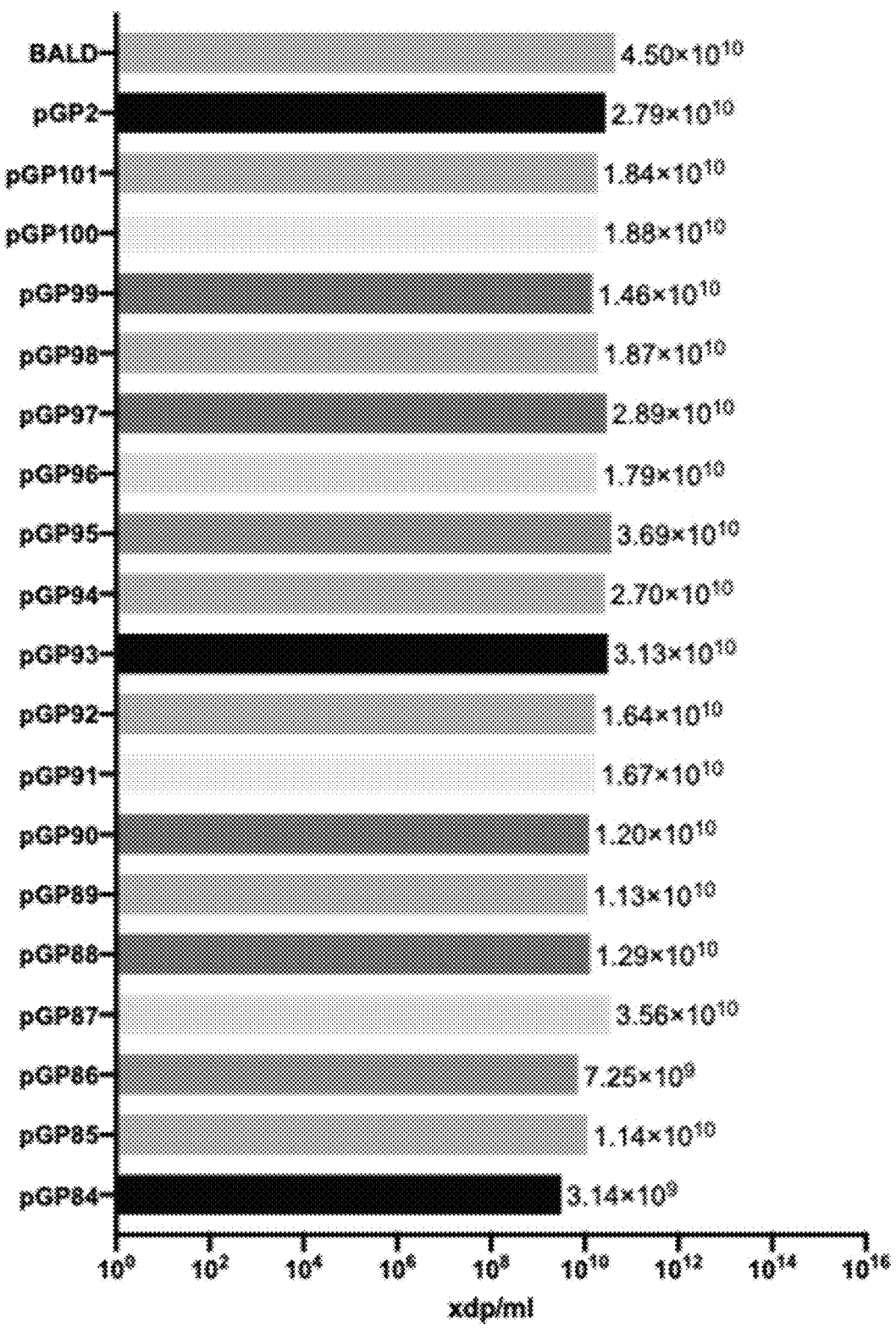

FIG. 63 is a bar chart showing the titers for the XDP constructs having various incorporated glycoproteins, determined by P24 ELISA and plotted as XDP/ml, as described in Example 21. All the constructs showed comparable levels of production.

Figure 64:
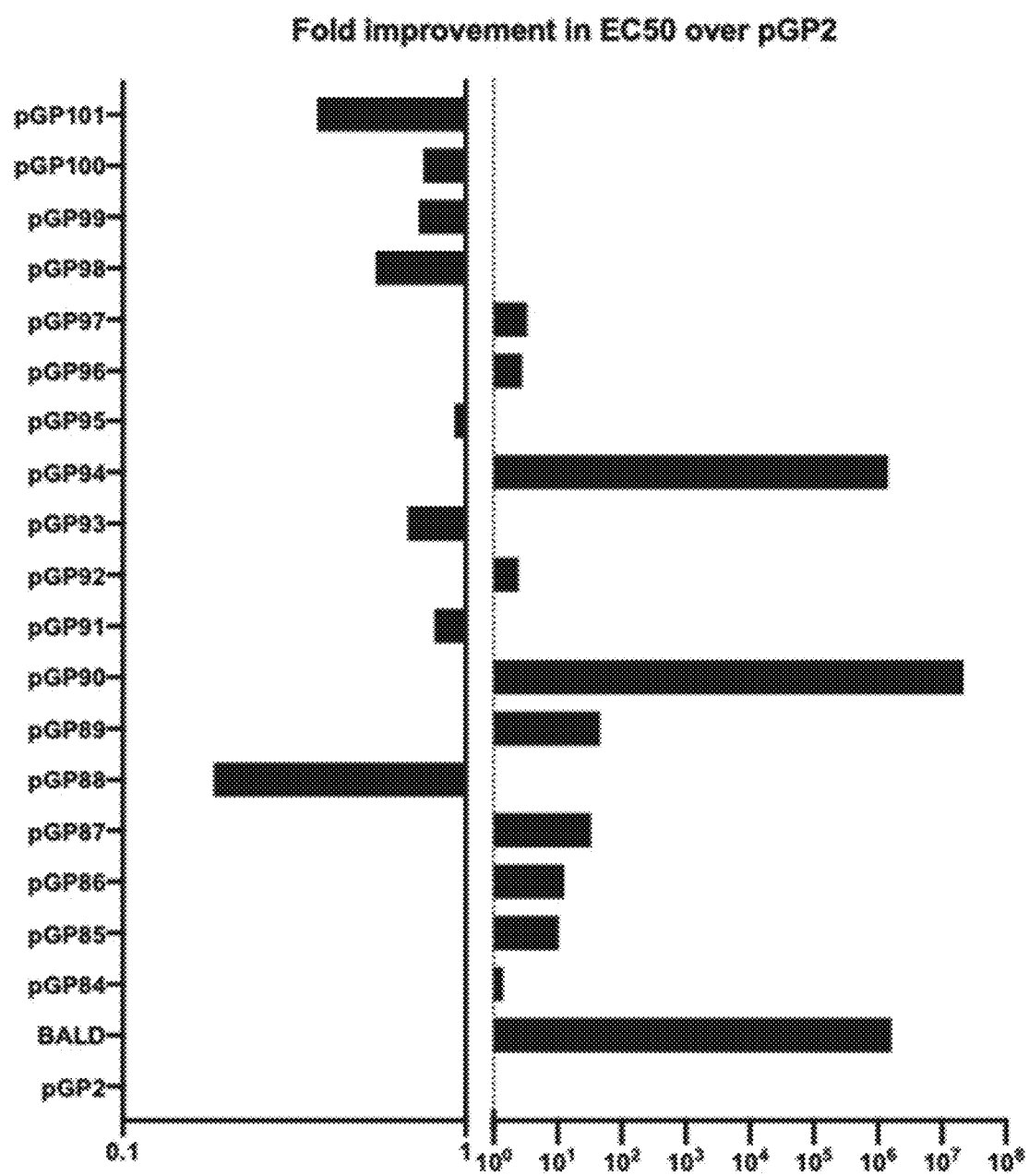

FIG. 64 is a bar chart of editing data showing the fold change in EC50 values over the base control glycoprotein (pGP2; set to 1.0) for XDPs either pseudotyped with different glycoproteins or produced as bald (without a targeting moiety), as described in Example 21.

Figure 65:
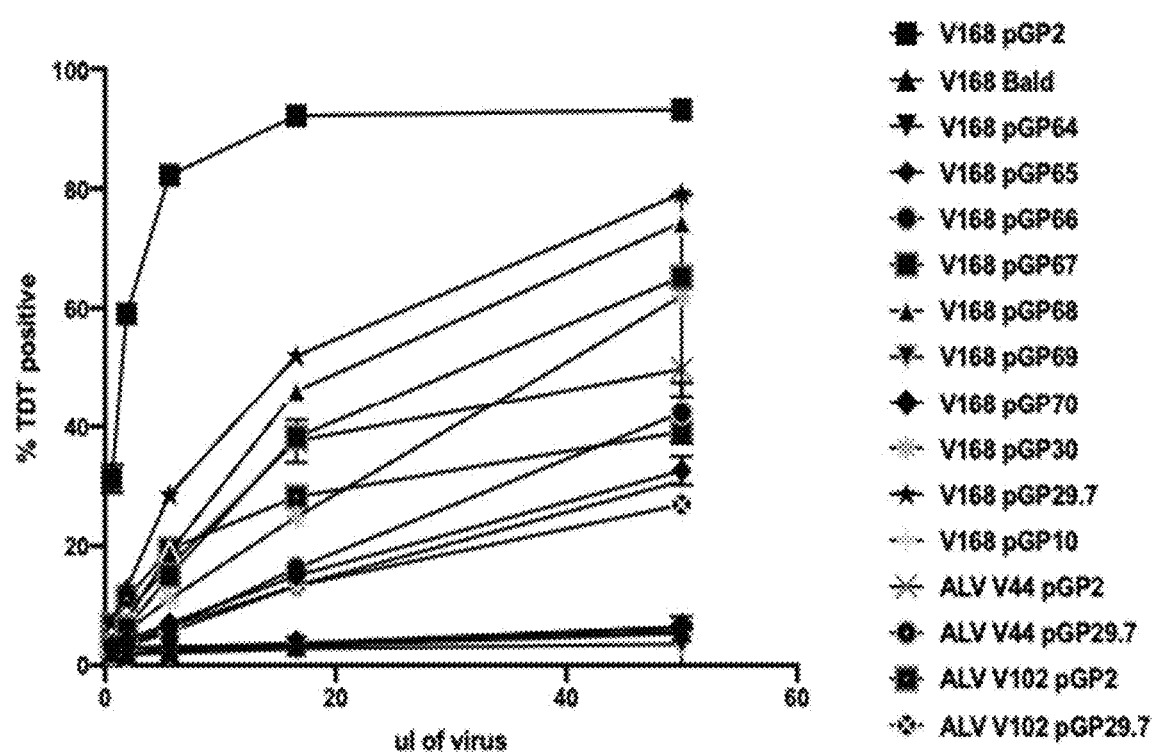

FIG. 65 is a graph of editing results with XDP constructs based on HIV (V168) or Alphavirus (V44 and V102) having various incorporated glycoproteins used to edit tdTomato in NPCs in terms of volume of XDP added to treat the cells, as described in Example 22.

Figure 66:
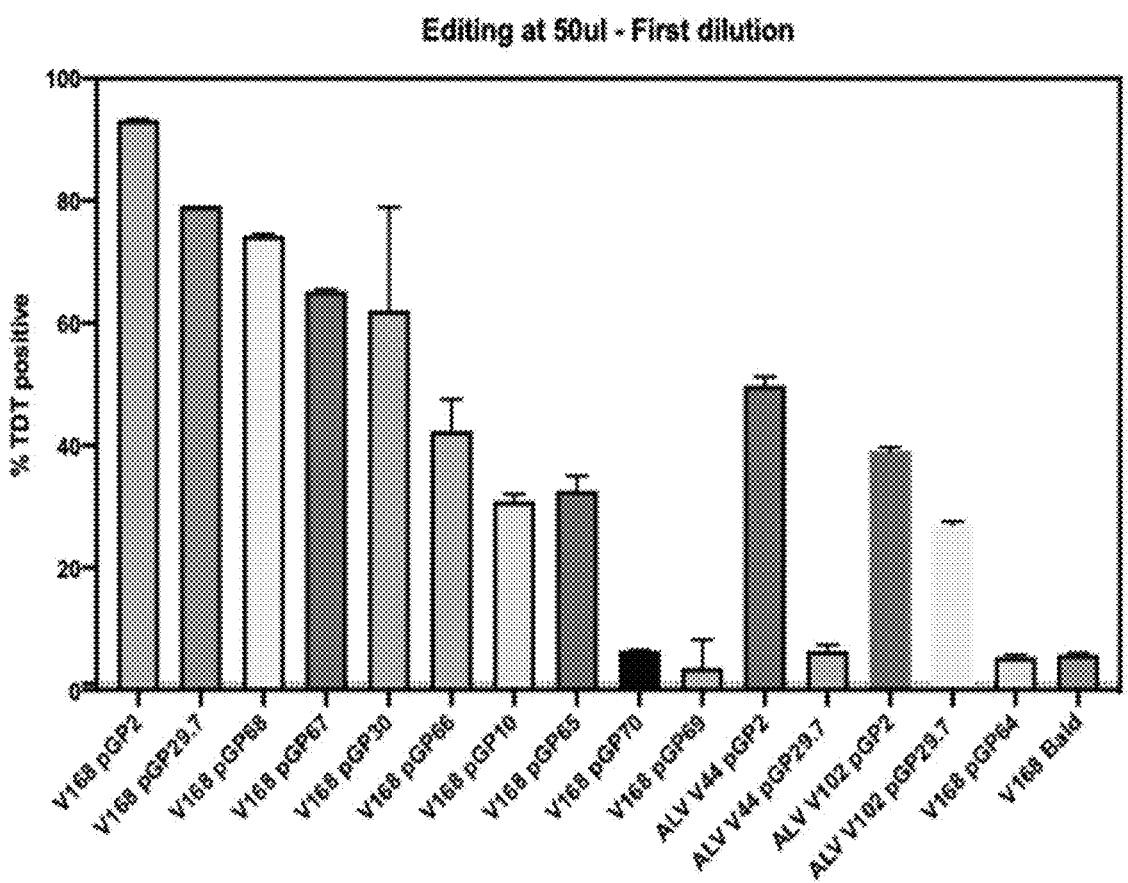

FIG. 66 is a bar chart of editing results with XDP constructs based on HIV (V168) or Alphavirus (V44 and V102) having various incorporated glycoproteins used to edit tdTomato in NPCs treated with the indicated volume of XDPs, as described in Example 22.

Figure 67:
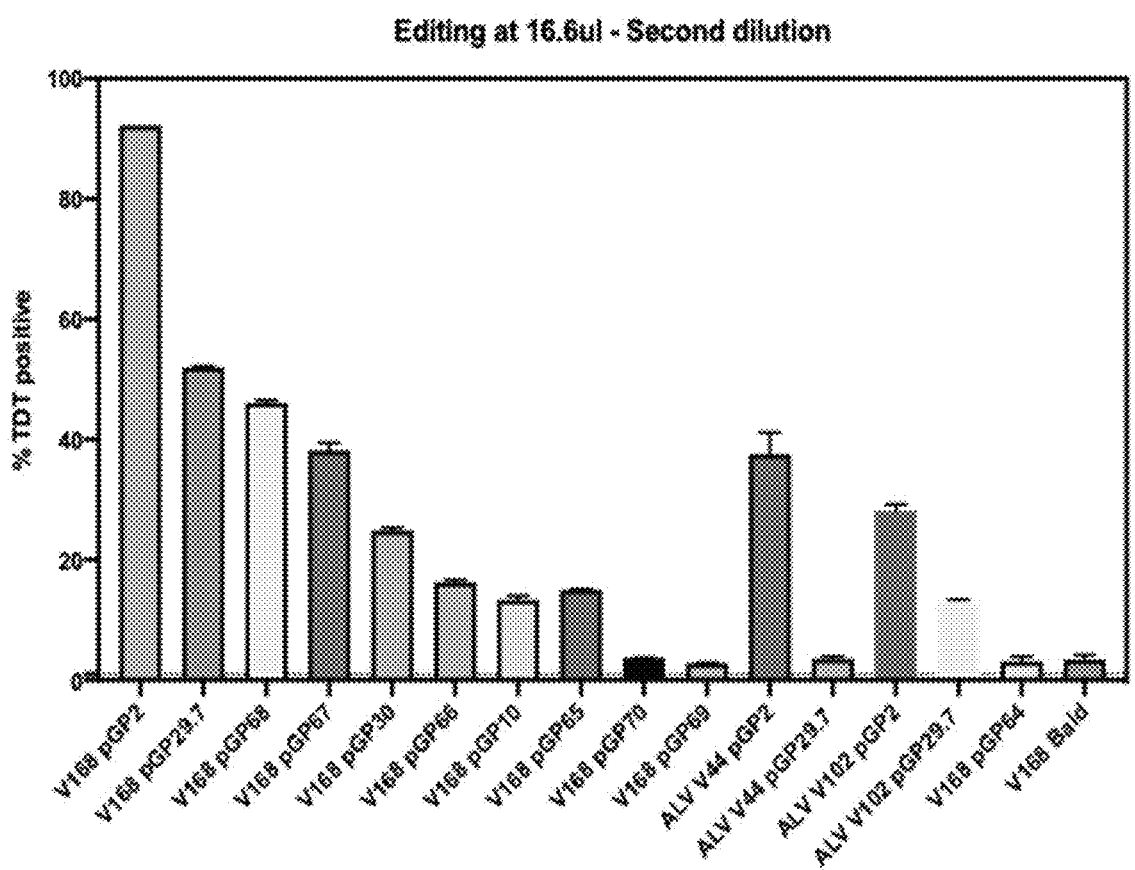

FIG. 67 is a bar chart of editing results with XDP constructs based on HIV (V168) or Alphavirus (V44 and V102) having various incorporated glycoproteins used to edit tdTomato in NPCs treated with the indicated volume of XDPs, as described in Example 22.

Figure 68:
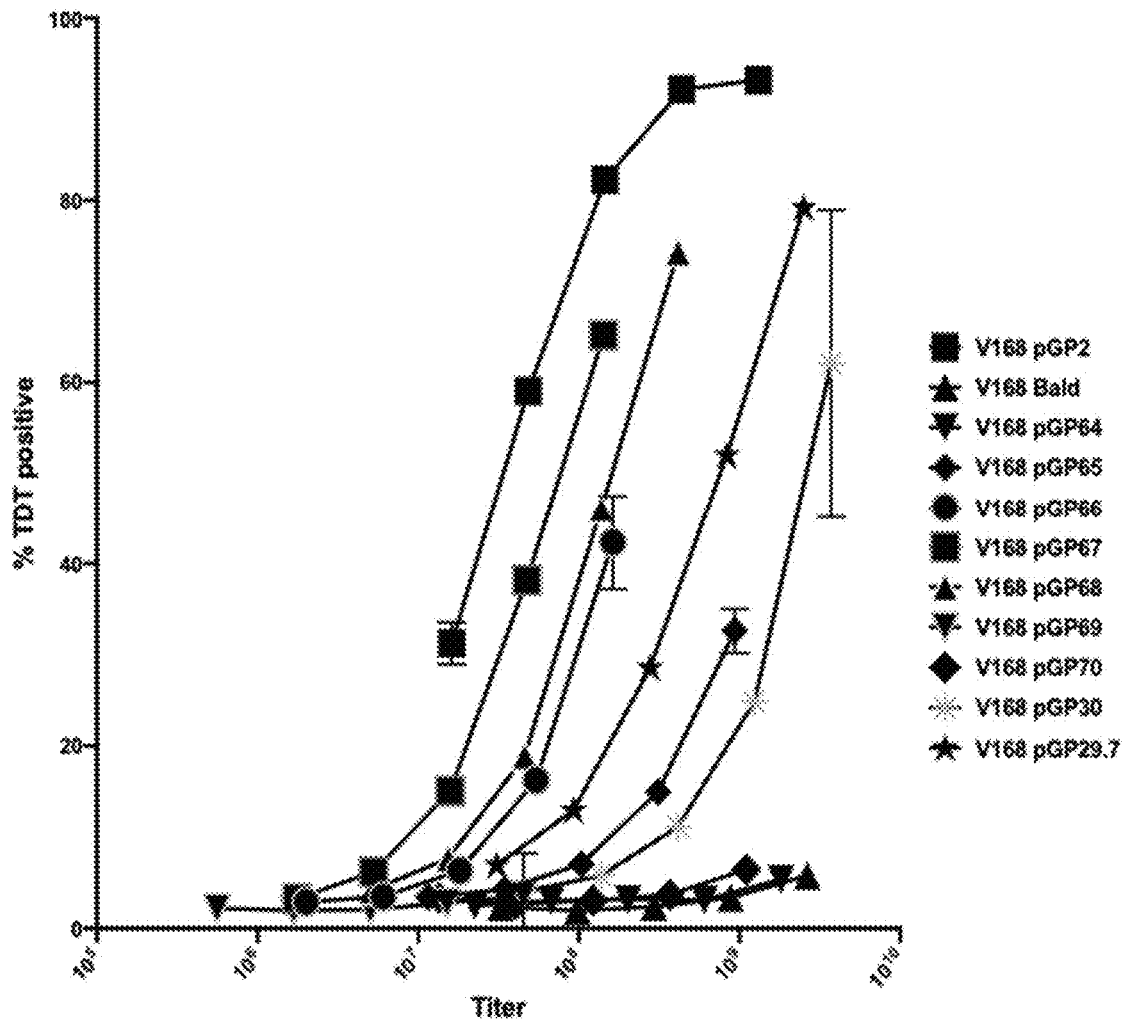

FIG. 68 is a graph of editing results with XDP constructs based on HIV (V168) having various incorporated glycoproteins (or bald negative control) used to edit tdTomato in NPCs across a range of titered volumes of XDP added to treat the cells, as described in Example 22.

Figure 69:
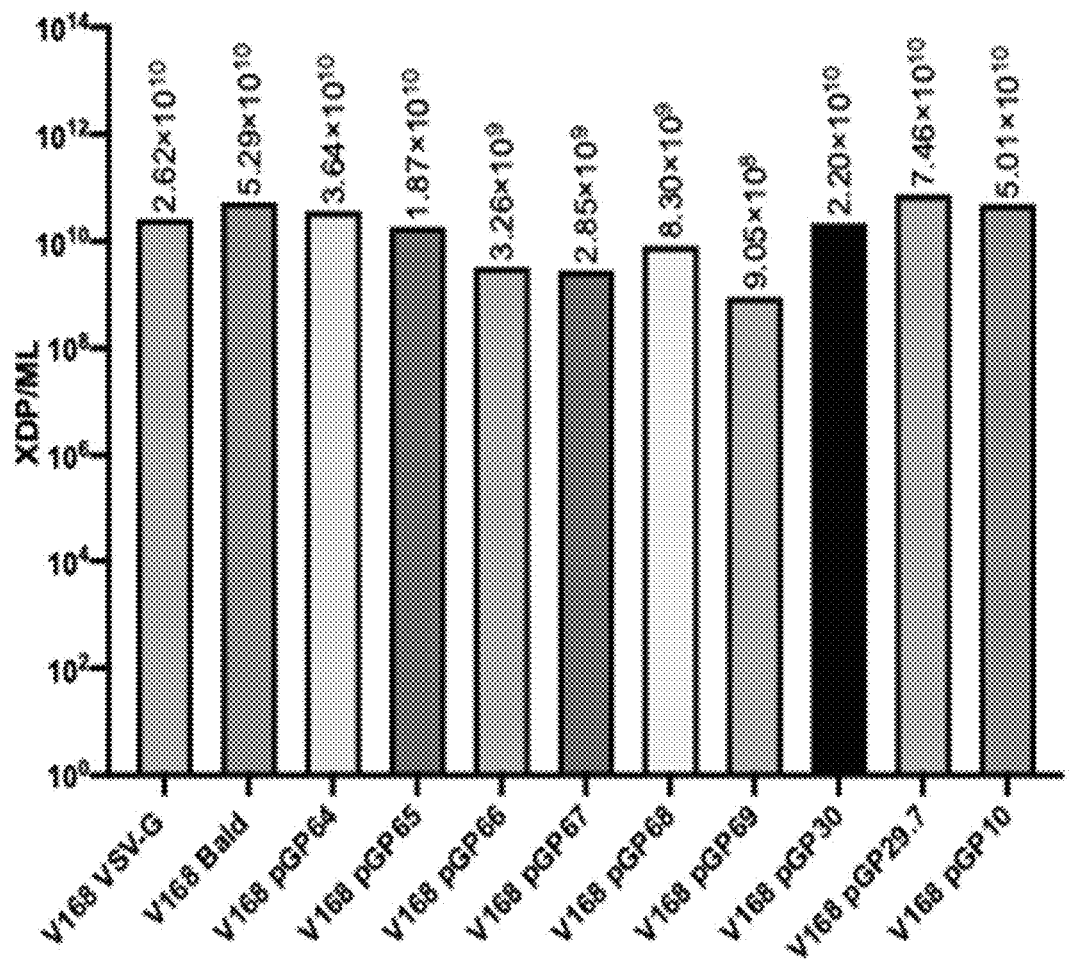

FIG. 69 is a bar chart showing the titers for the XDP constructs based on HIV (V168) having various incorporated glycoproteins, determined by P24 ELISA and plotted as XDP particles per milliliter, as described in Example 22. All the constructs showed comparable levels of production.

Figure 70:
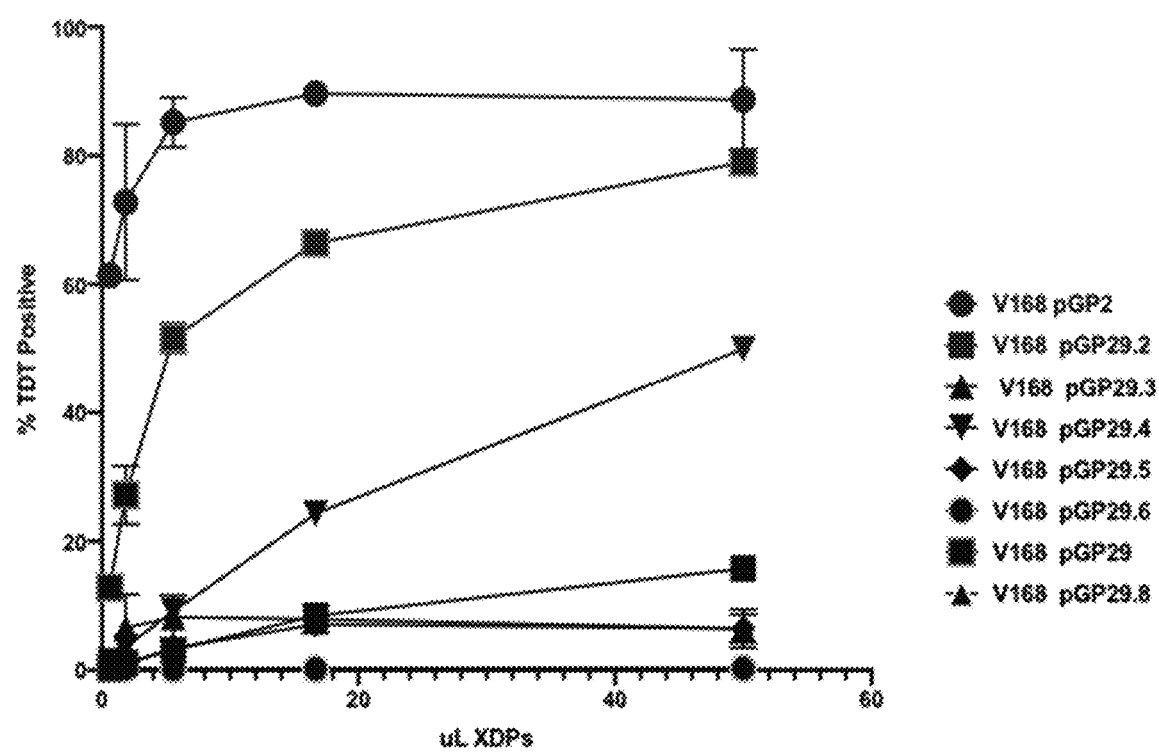

FIG. 70 is a graph of editing results with XDP constructs based on HIV (V168) having incorporated glycoproteins from rabies variants used to edit tdTomato in NPCs across a range of volumes of XDP added to treat the cells, as described in Example 22.

Figure 71:
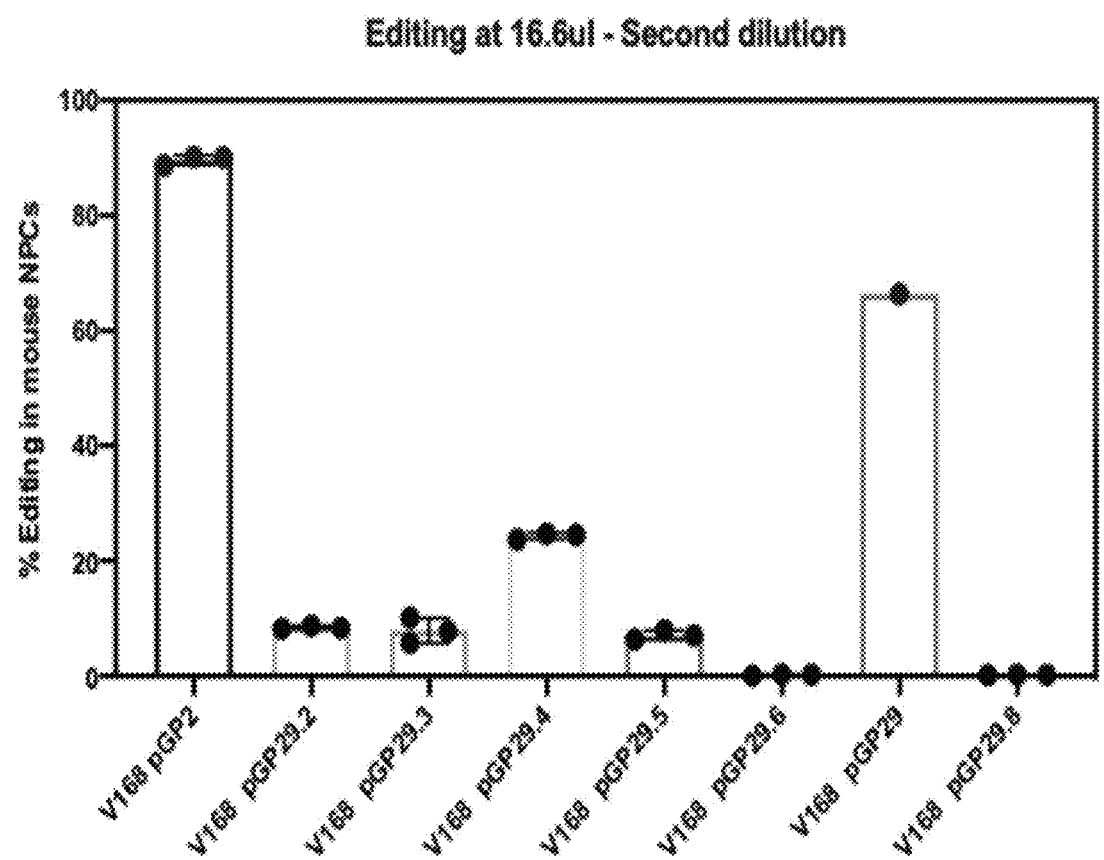

FIG. 71 is a bar chart of editing results with XDP constructs based on HIV (V168) having incorporated glycoproteins from rabies variants used to edit tdTomato in NPCs across the indicated volume of XDP added to treat the cells, as described in Example 22.

Figure 72:
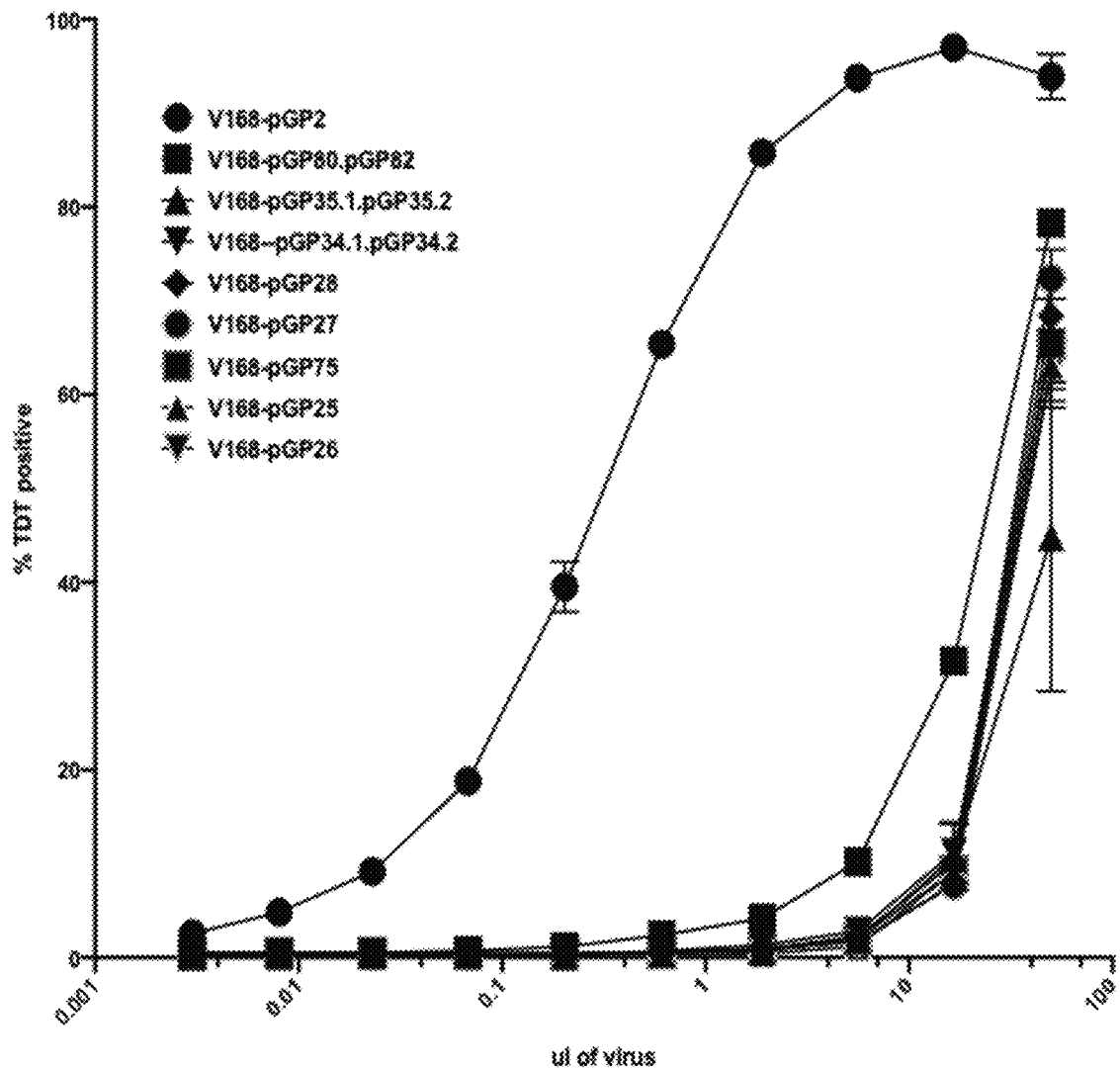

FIG. 72 is a graph of editing results with XDP constructs based on HIV (V168) having incorporated glycoproteins from Paramyxoviridae, Orthomyxoviridae, and Flaviviridae used to edit tdTomato (TDT) in NPCs across a range of volumes of XDP added to treat the cells, as described in Example 22.

Figure 73:
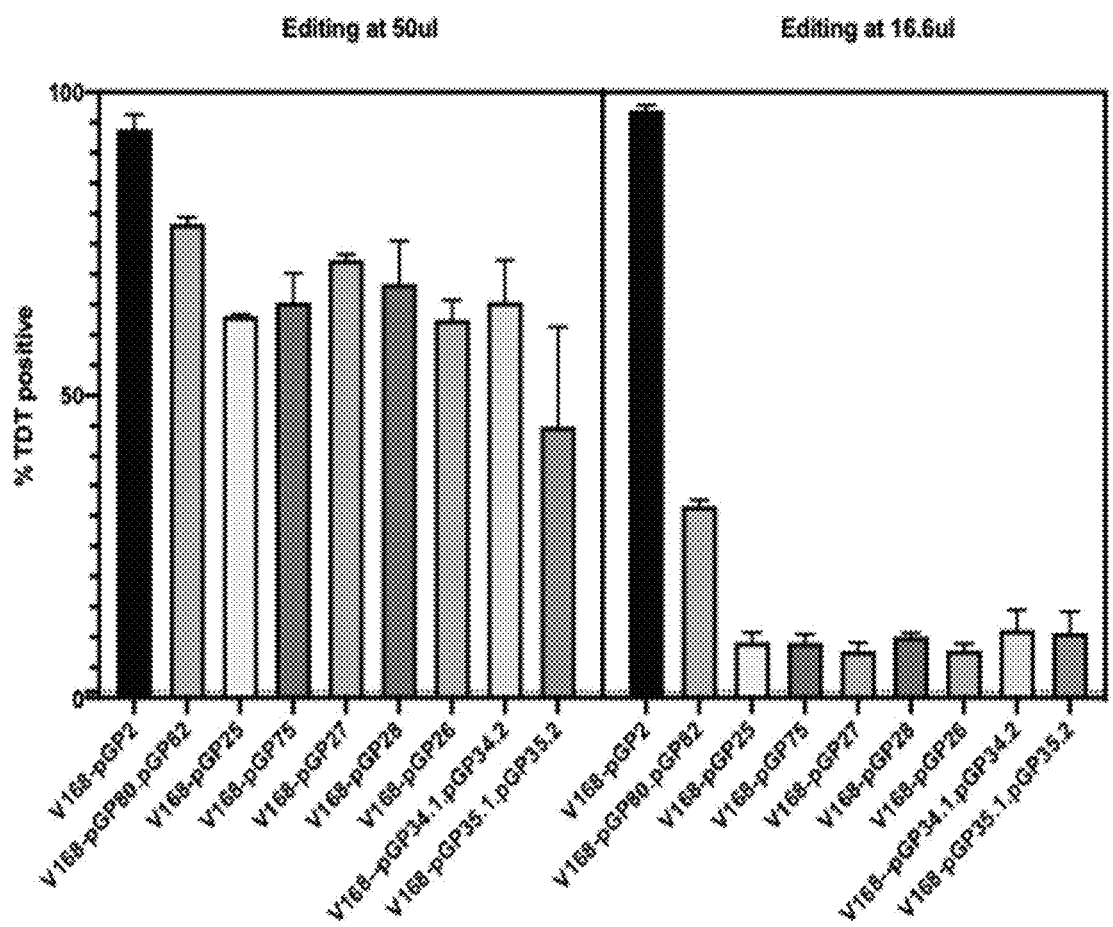

FIG. 73 is a bar chart of editing results with XDP constructs based on HIV (V168) having various incorporated glycoproteins used to edit tdTomato in NPCs across the indicated volumes of XDP added to treat the cells, as described in Example 22.

Figure 74:
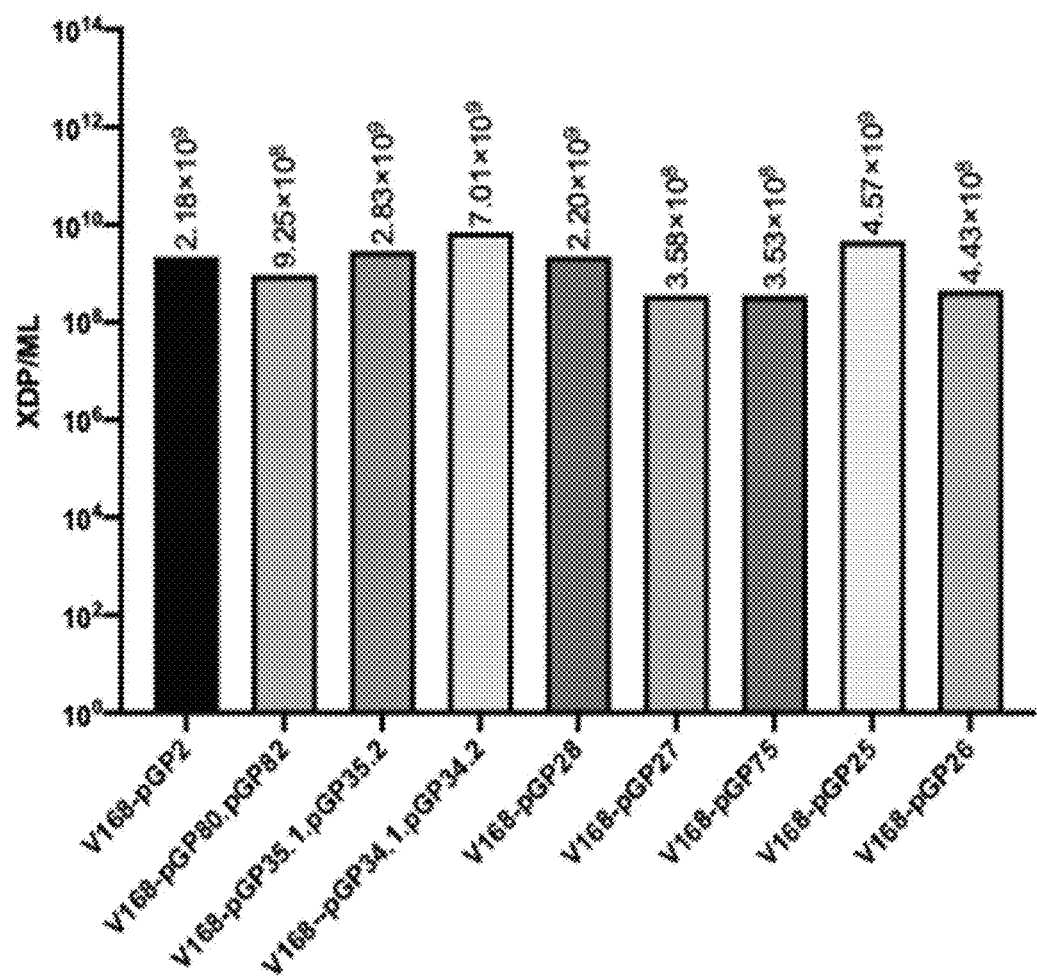

FIG. 74 is a bar chart showing the titers for the XDP constructs based on HIV (V168) having various incorporated glycoproteins, determined by P24 ELISA and plotted as XDP/ml, as described in Example 22. All the constructs showed comparable levels of production.

Figure 75:
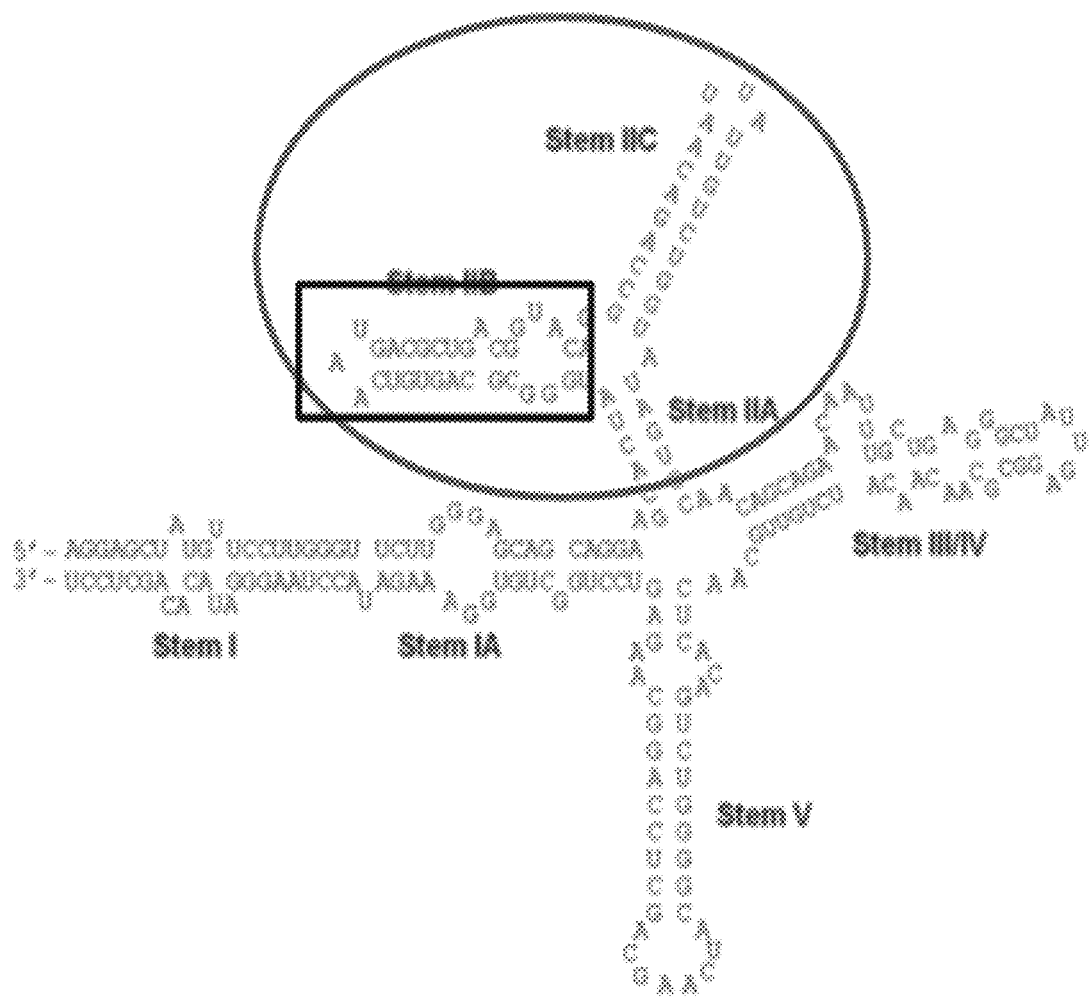

FIG. 75 is a schematic of the RNA secondary structure of the Rev Response Element (RRE) with stem II circled and stem IIB boxed (folds predicted using Varna software), as described in Example 24. The sequence shown in FIG. 75 is SEQ ID NO: 572.

Figure 76:
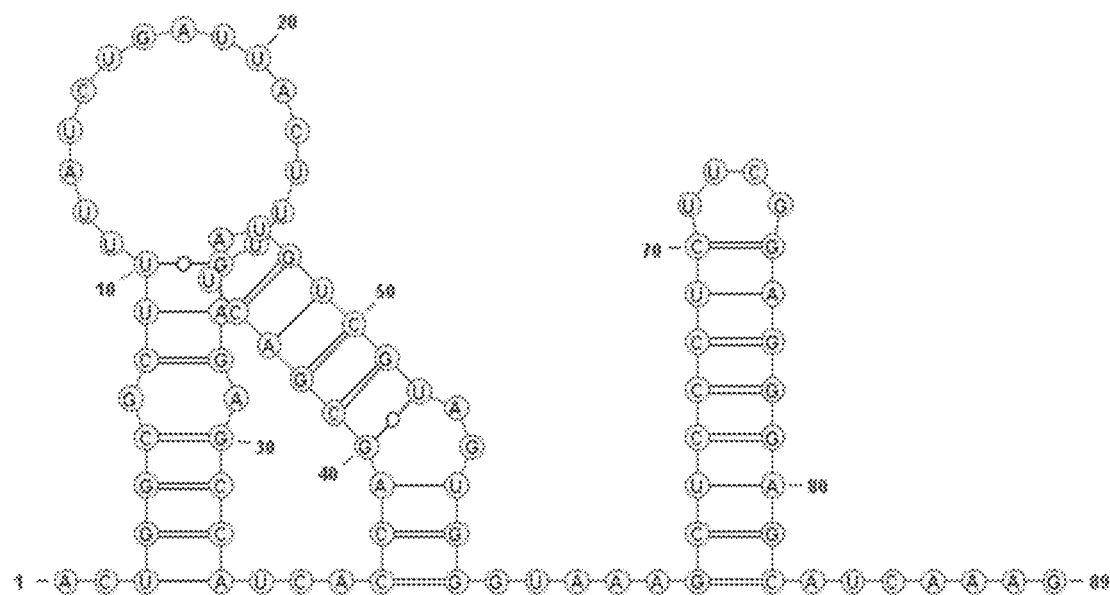

FIG. 76 is a schematic of the RNA secondary structure of guide scaffold 174, as described in Example 24. The sequence shown in FIG. 76 is SEQ ID NO: 2238.

Figure 77:
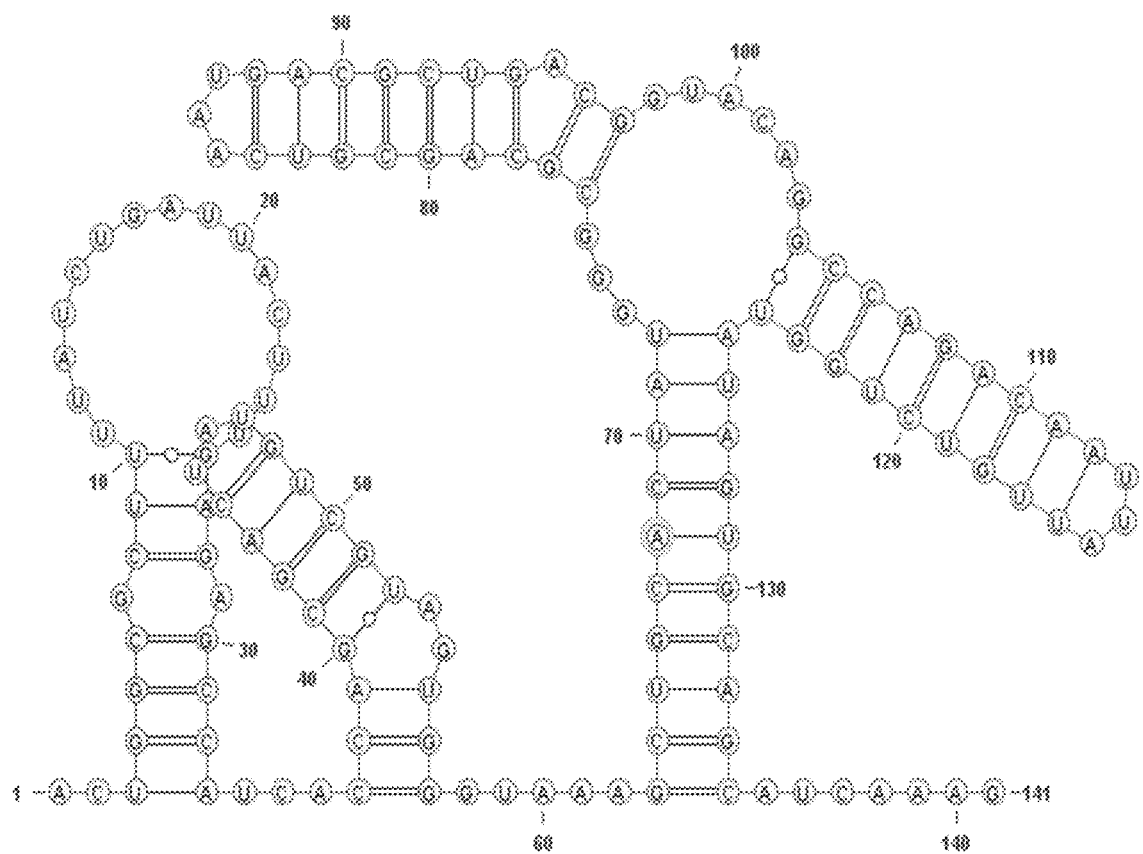

FIG. 77 is a schematic of the RNA secondary structure of guide scaffold 226 which has Stem II from the RRE, as described in Example 24. The sequence shown in FIG. 77 is SEQ ID NO: 2380.

Figure 78:
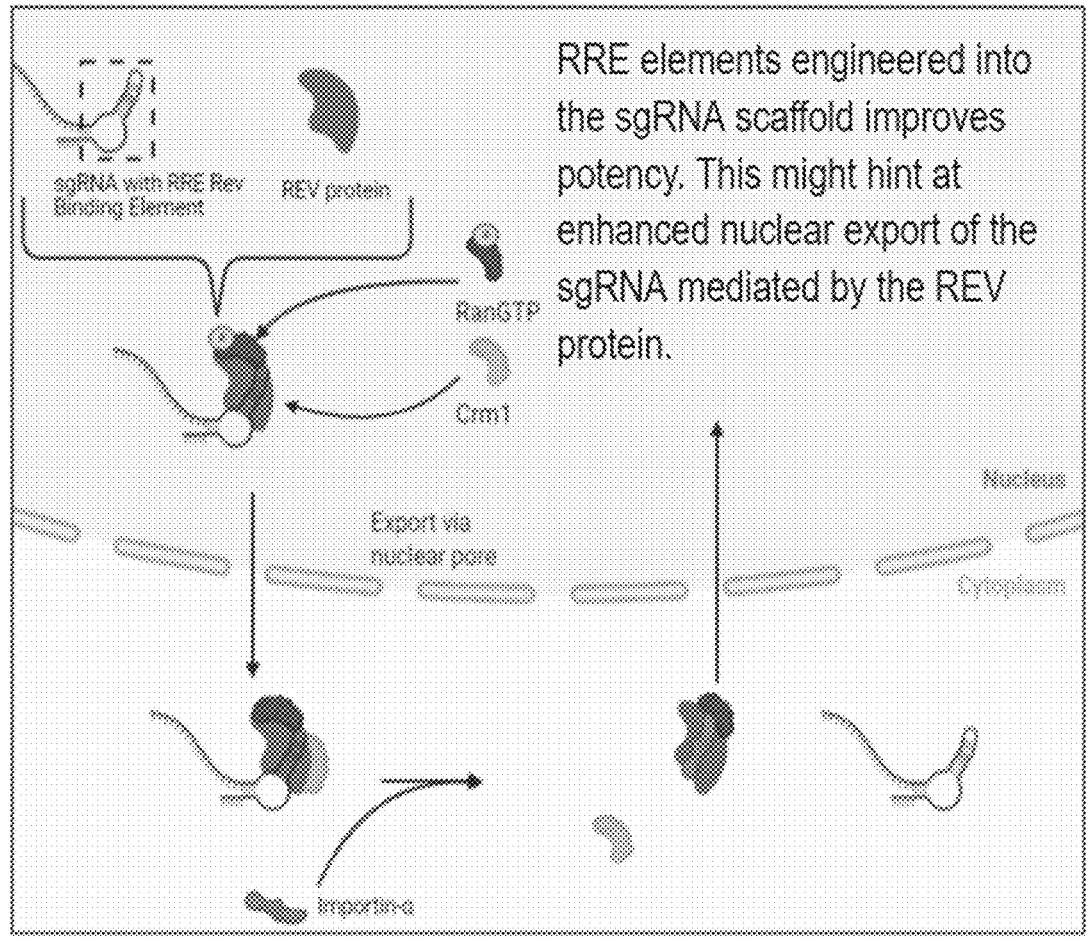

FIG. 78 is a diagram of the proposed recruitment mechanism of RRE elements by which RRE incorporated into the guide RNA effects the transport of the guide out of the nucleus and into the cytoplasm of the XDP producing cell, as described in Example 24.

Figure 79:
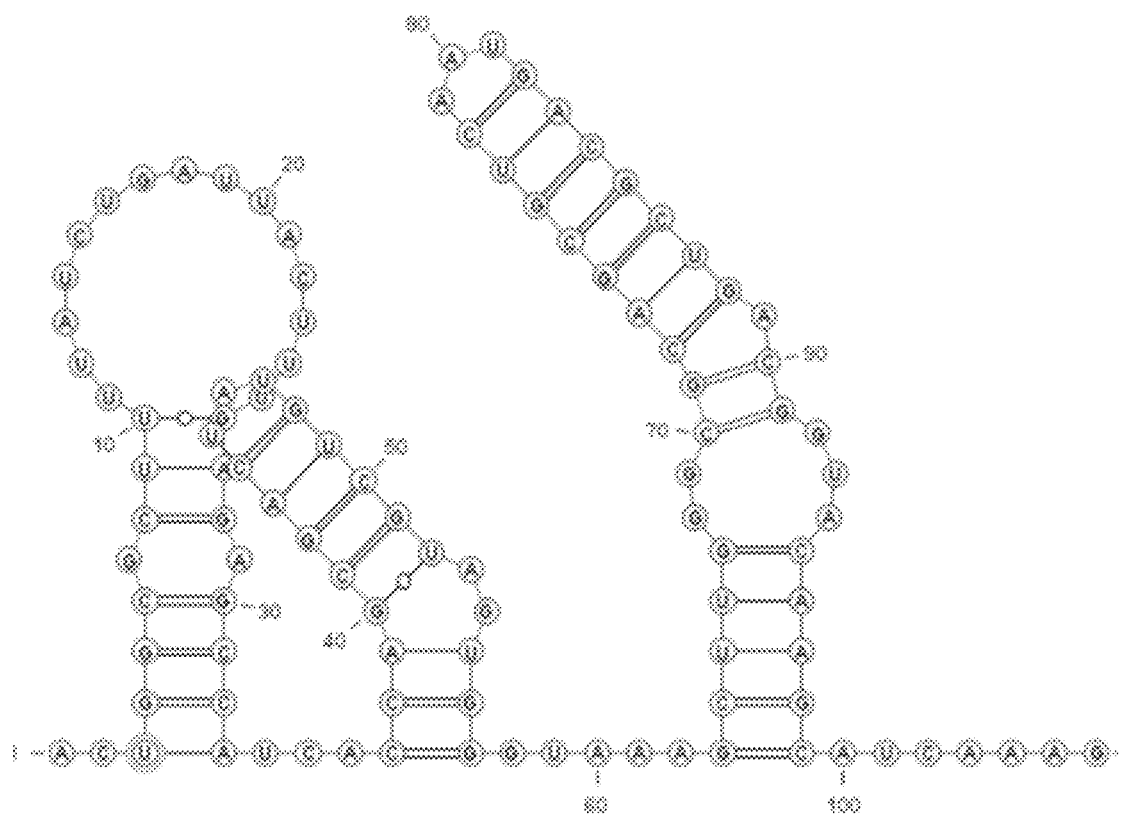

FIG. 79 is a schematic of the RNA secondary structure of guide scaffold 249, which incorporates stem IIB of the HIV-1 RRE element, as described in Example 25. The sequence shown in FIG. 79 is SEQ ID NO: 2306.

Figure 80:
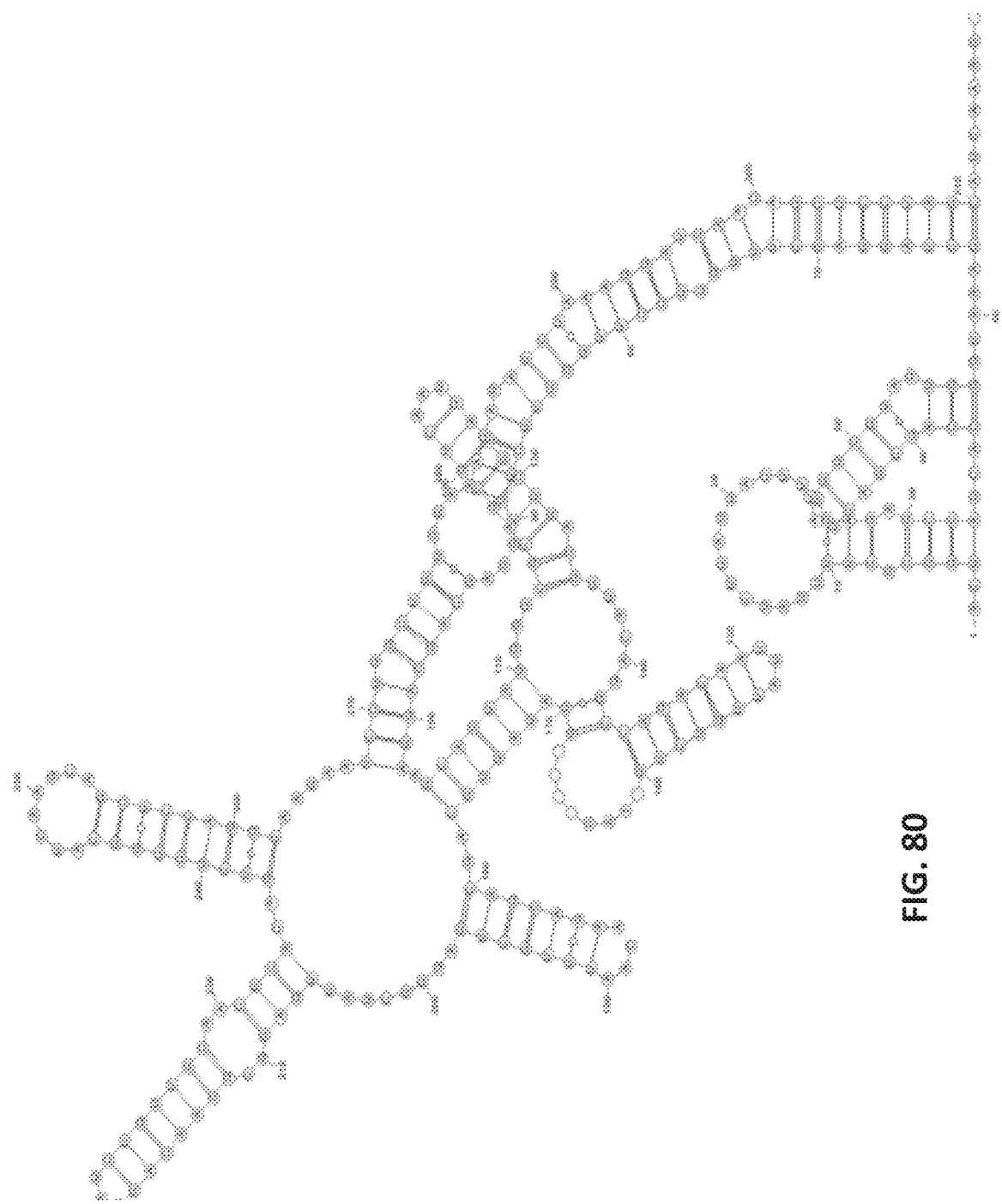

FIG. 80 is a schematic of the RNA secondary structure of guide scaffold 227, which incorporates the entire RRE element, as described in Example 25. The sequence shown in FIG. 80 is SEQ ID NO: 2373.

Figure 81:
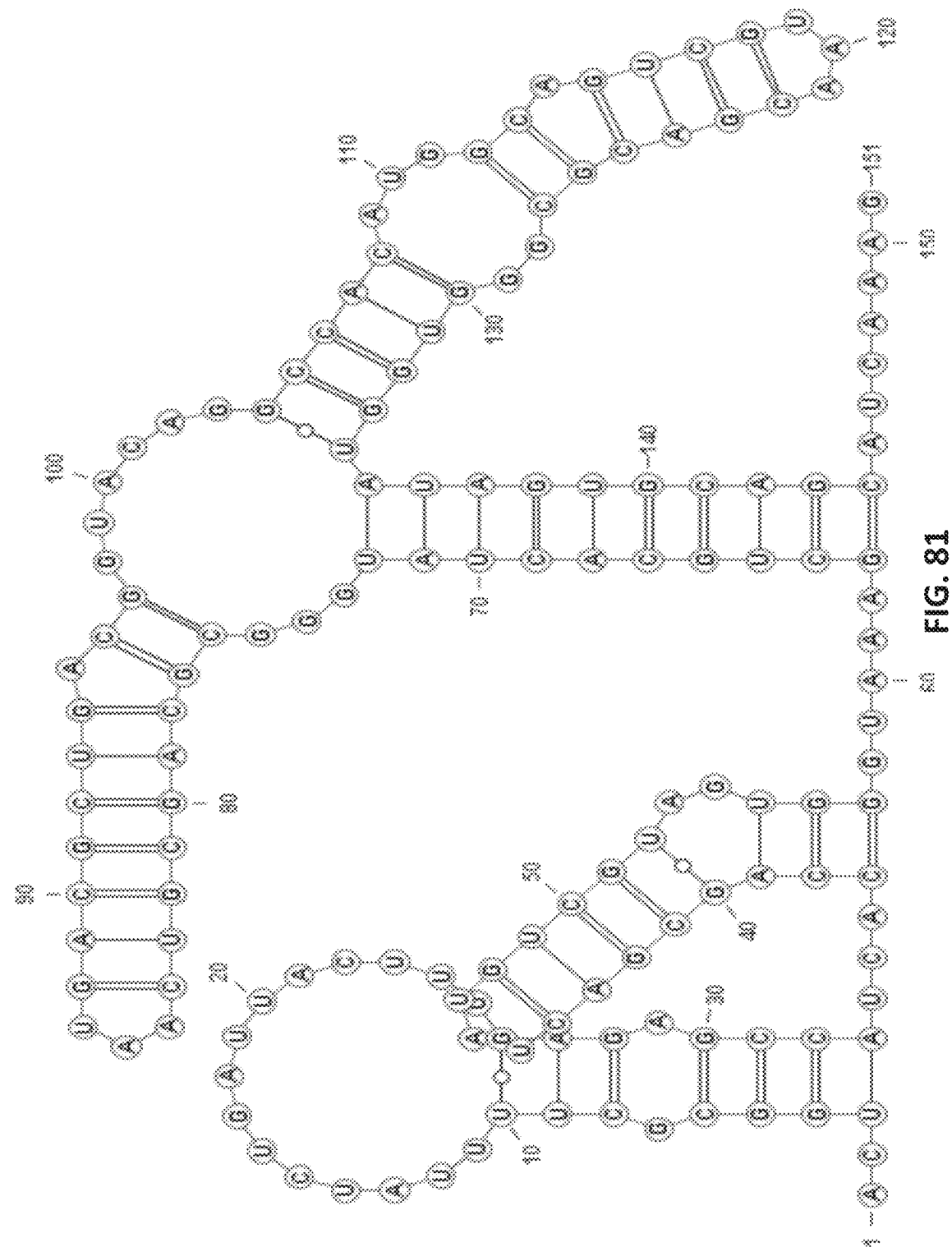

FIG. 81 is a schematic of the RNA secondary structure of guide scaffold 252, which incorporates an RBE element on the right stem, as described in Example 25. The sequence shown in FIG. 81 is SEQ ID NO: 2309.

Figure 82:
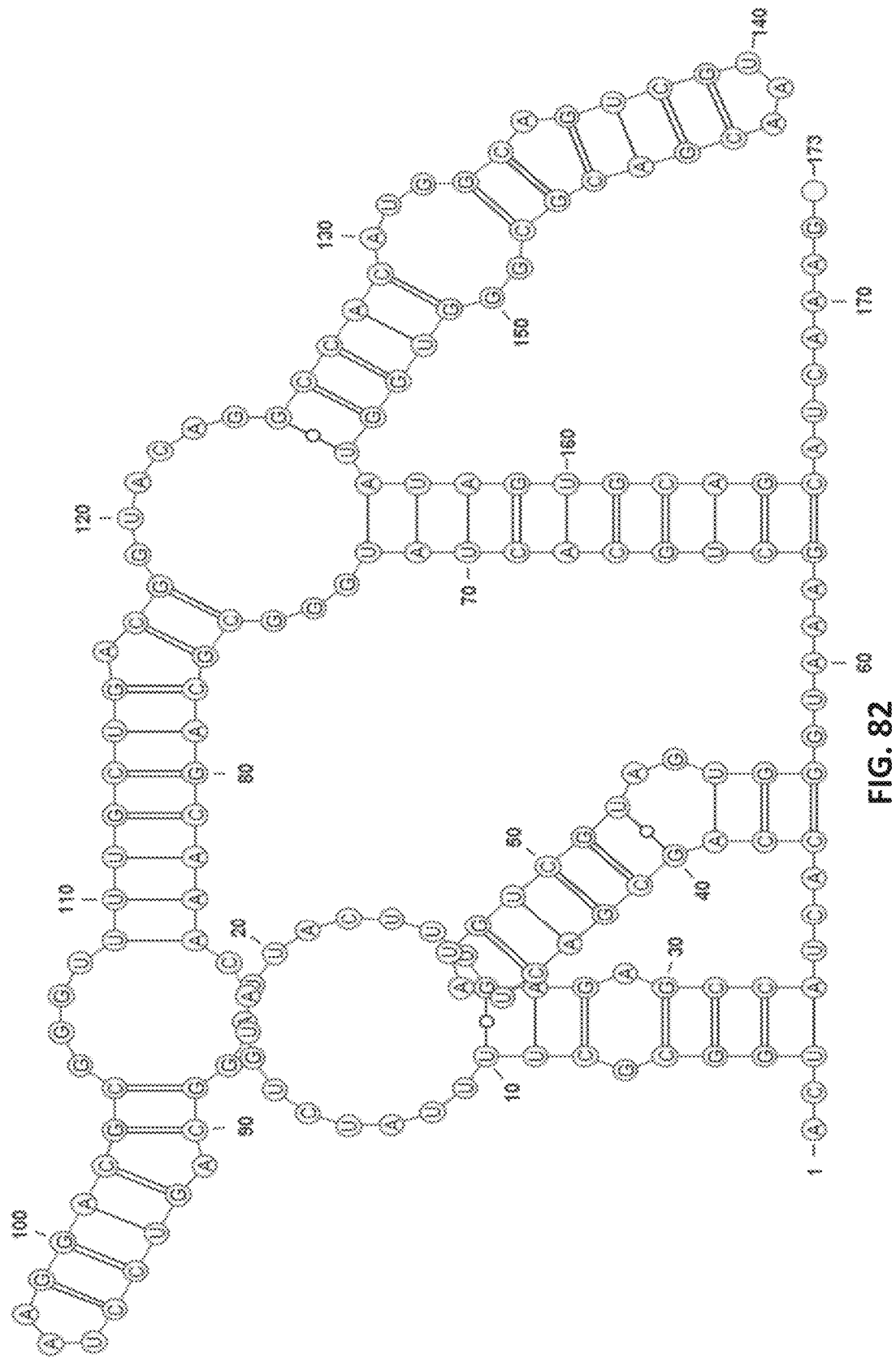

FIG. 82 is a schematic of the RNA secondary structure of guide scaffold 253, which incorporates RBE elements on the left and the right stem, as described in Example 25. The sequence shown in FIG. 82 is SEQ ID NO: 2310.

Figure 83:
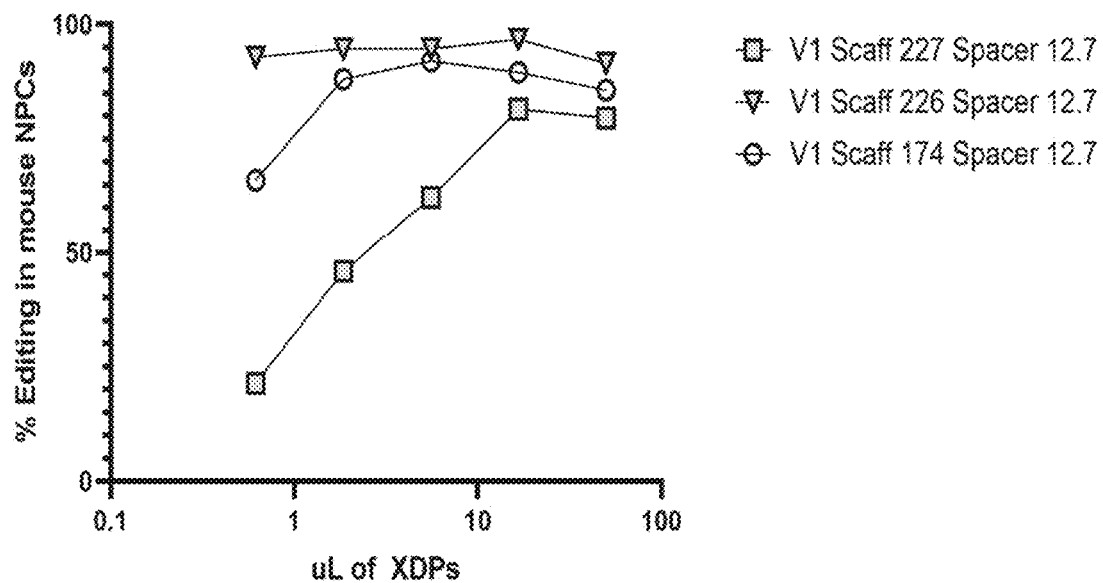

FIG. 83 is a graph of editing results with XDP constructs based on HIV (V1) with two guides having incorporated RRE elements (compared to the guide 174 control) used to edit tdTomato in NPCs across a range of volumes of XDP added to treat the cells, as described in Example 25.

Figure 84:
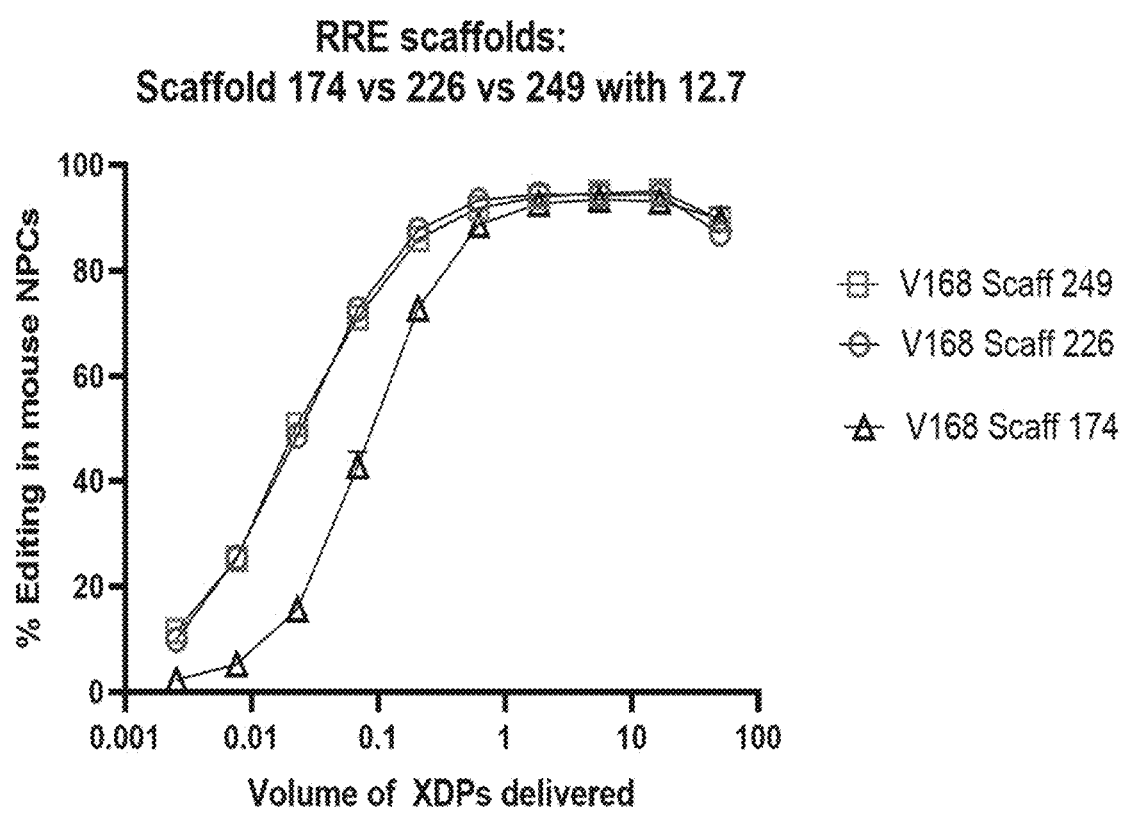

FIG. 84 is a graph of editing results with XDP constructs based on HIV (V168) with two guides having incorporated RRE elements (compared to the guide 174 control) used to edit tdTomato in NPCs across a range of volumes of XDP added to treat the cells, as described in Example 25.

Figure 85:
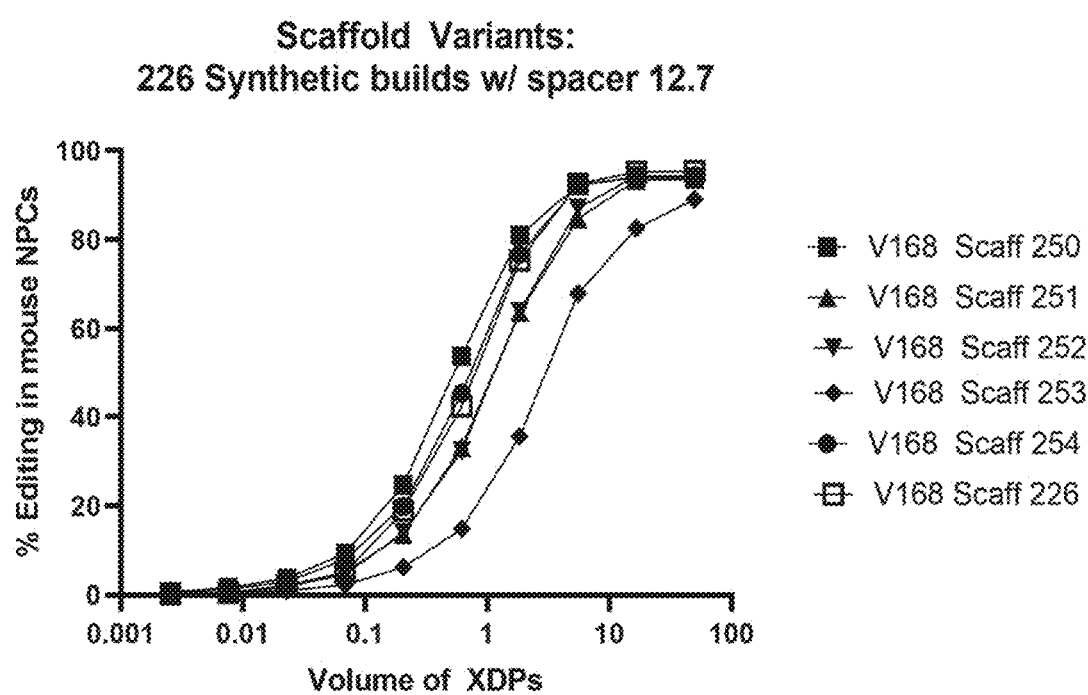

FIG. 85 is a graph of editing results with XDP constructs based on HIV (V168) with six guides having incorporated RRE elements used to edit tdTomato in NPCs across a range of volumes of XDP added to treat the cells, as described in Example 25.

Figure 86:
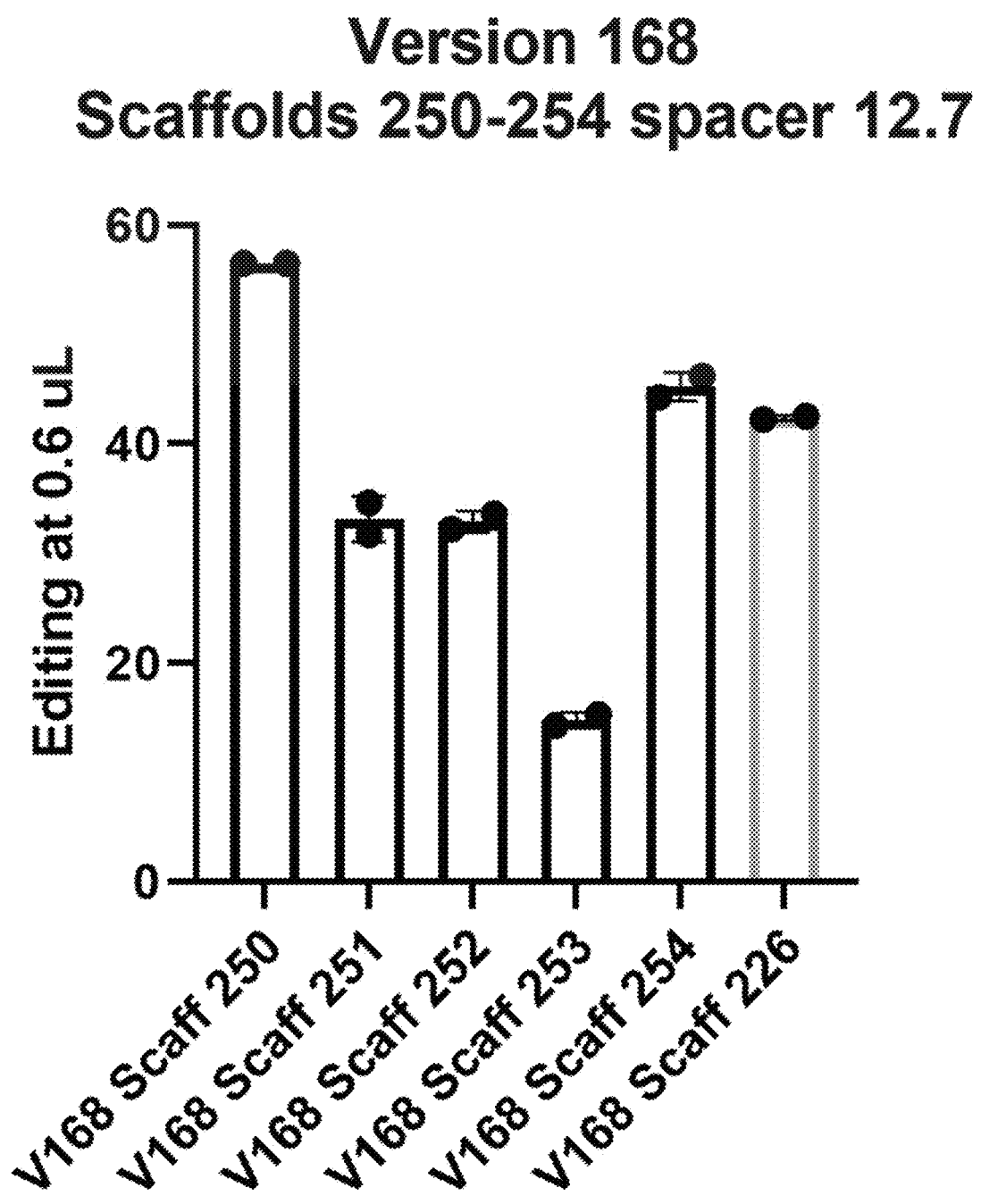

FIG. 86 is a bar chart of editing results with XDP constructs based on HIV (V168) with six guides having incorporated RRE elements used to edit tdTomato in NPCs using a 0.6 µl volume of XDP added to treat the cells, as described in Example 25.

Figure 87:
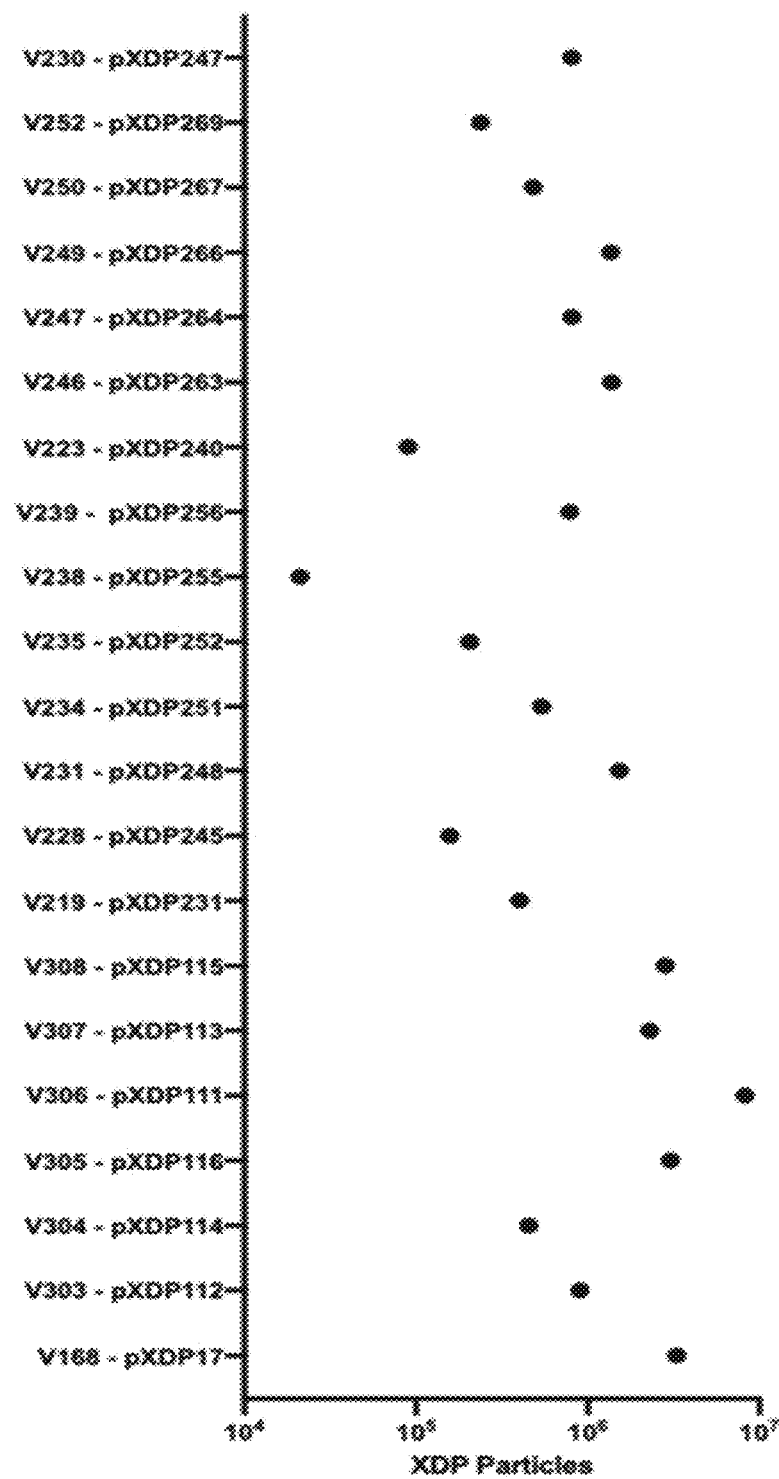

FIG. 87 is a scatterplot of EC50 values, based on the number of particles to achieve the EC50, for editing results with XDP constructs having various configurations of NLS linked to the CasX nuclease (or base control), with the XDP used to edit tdTomato in NPCs across the indicated volumes of XDP added to treat the cells, as described in Example 26.

Figure 88:
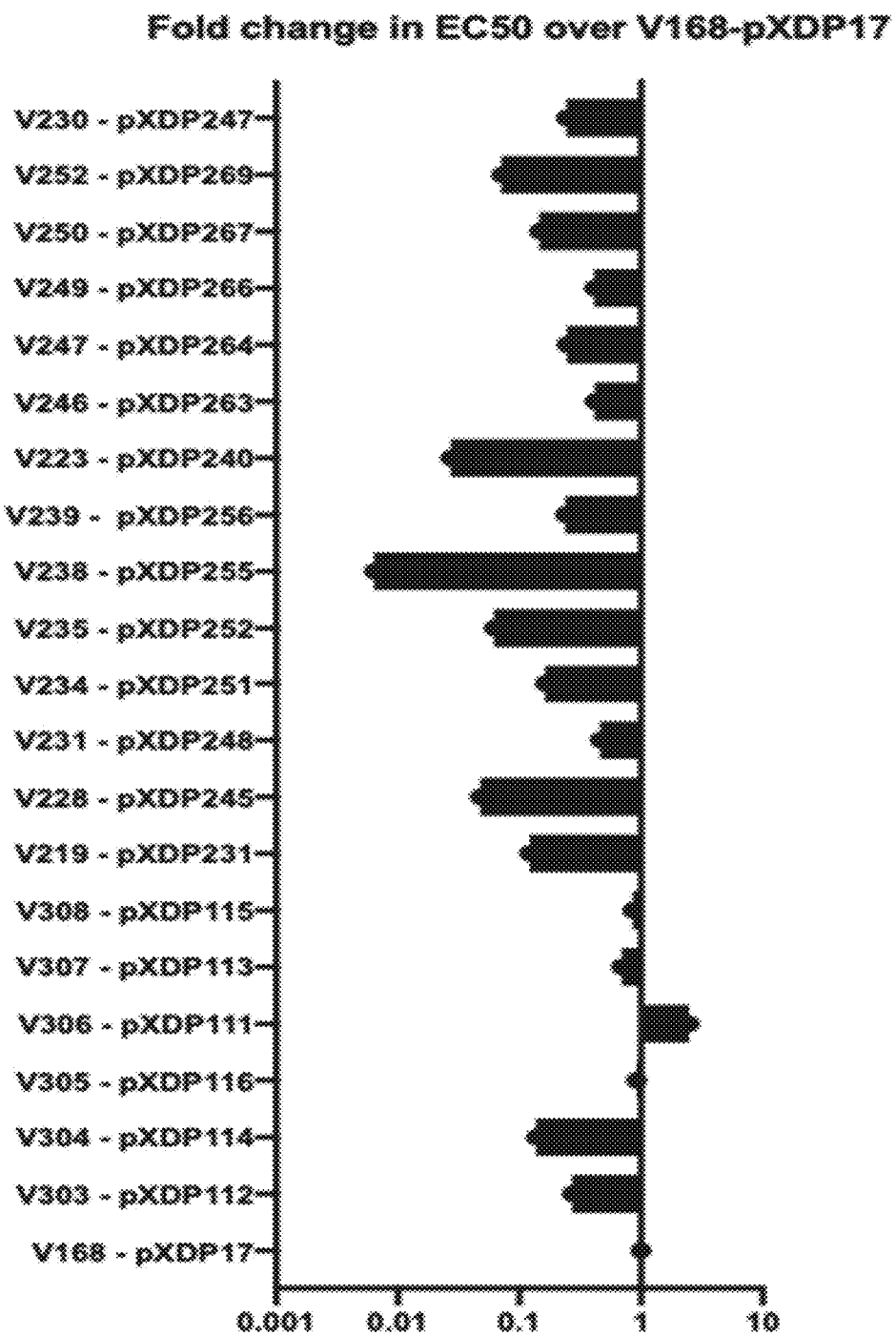

FIG. 88 is a bar chart showing the fold-change improvements in EC50 editing values of the NLS-configured XDP constructs compared to the base control (V168+ guide 226 having an RBE) for editing of tdTomato Neural progenitor cells, as described in Example 26.

Figure 89:
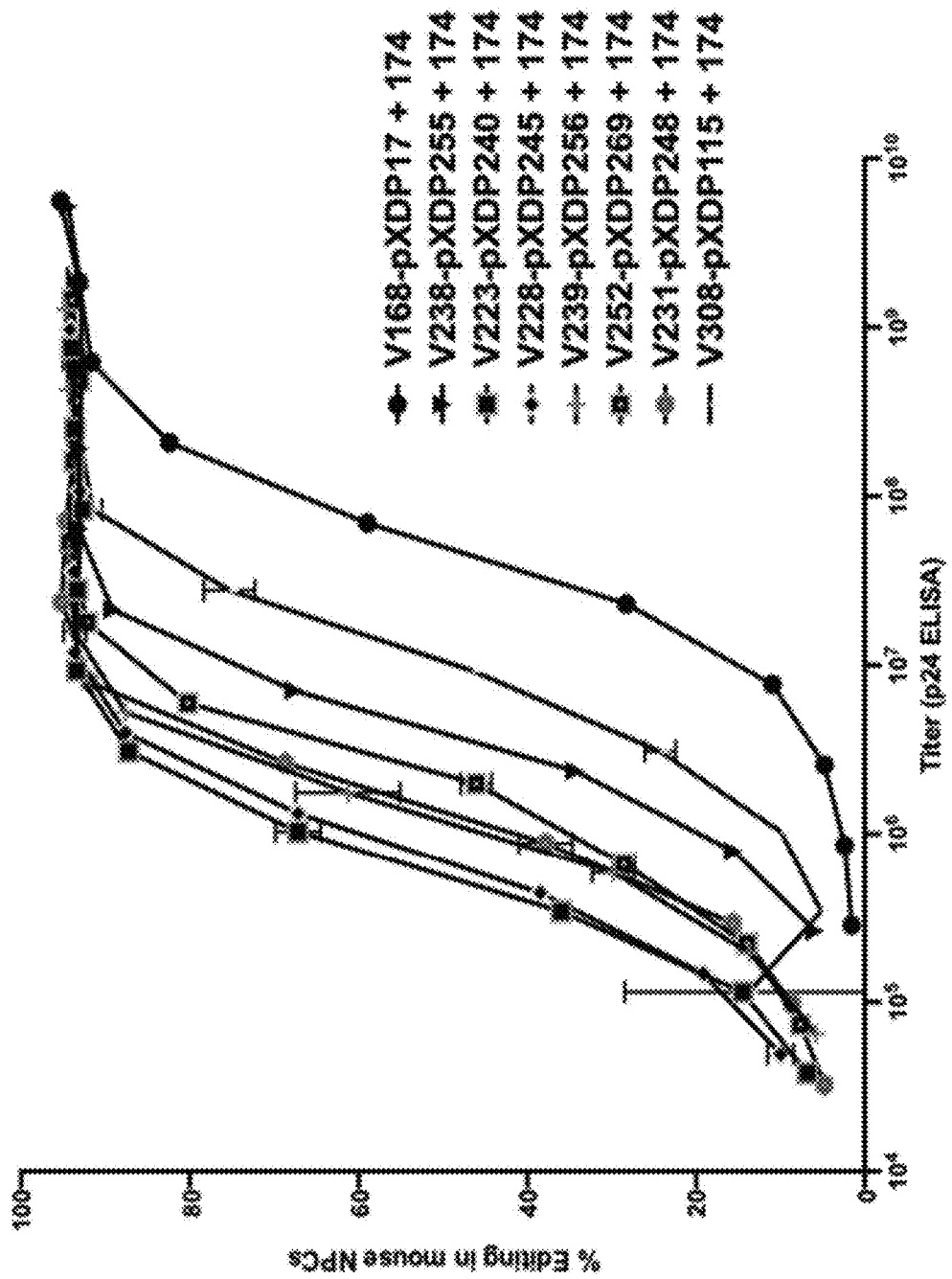

FIG. 89 is a graph of editing results with XDP constructs having various configurations of NLS linked to the CasX nuclease (or base control) and guides not having RBE, with the XDP used to edit tdTomato in NPCs across the indicated titers (determined by P24) of XDP added to treat the cells, as described in Example 26. XDPs were produced with guide scaffold 174.

Figure 90:
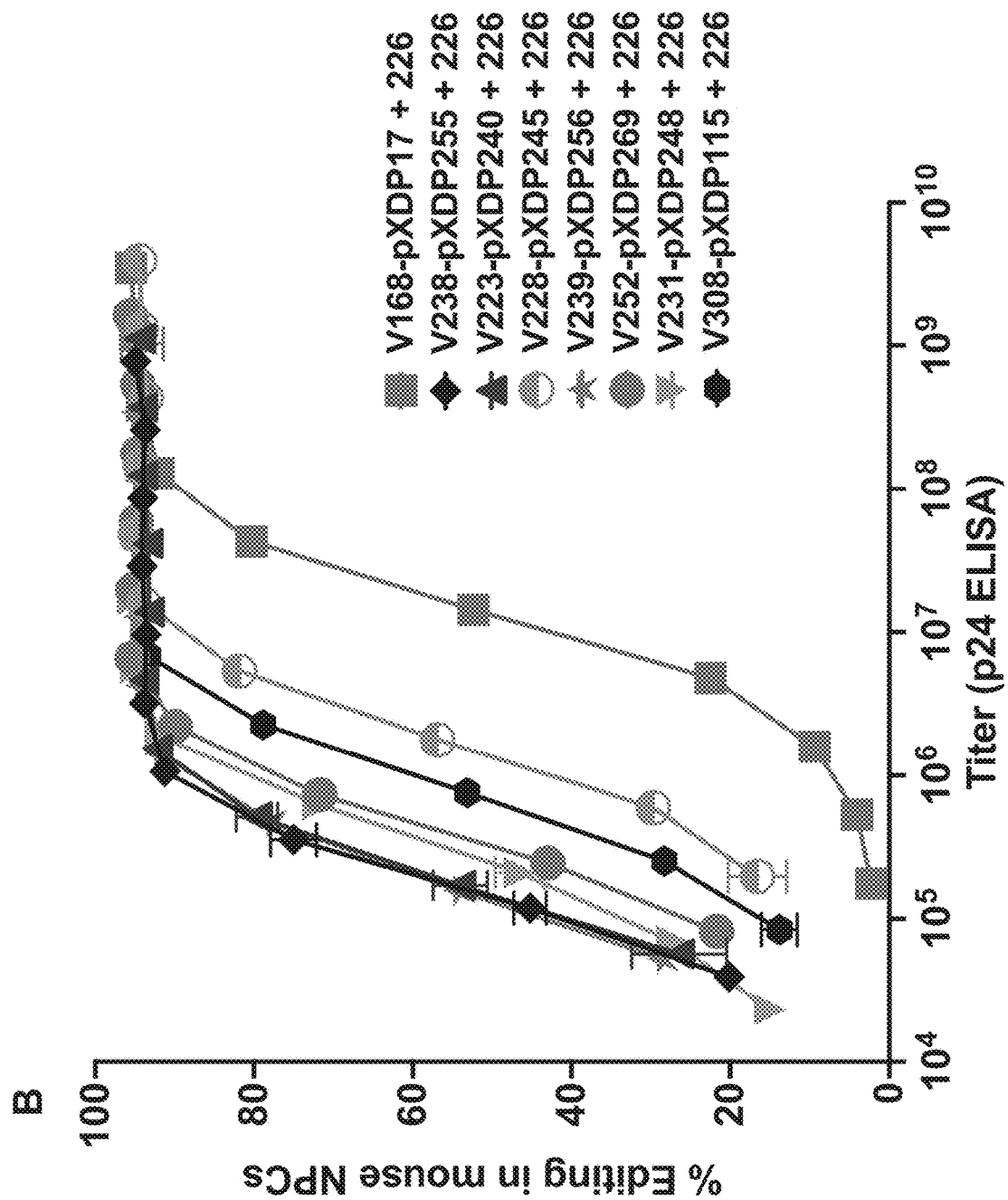

FIG. 90 is a graph of editing results with XDP constructs having various configurations of NLS linked to the CasX nuclease (or base control), with the XDP used to edit tdTomato in NPCs across the indicated titers (determined by P24) of XDP added to treat the cells, as described in Example 26. XDPs were produced with guide scaffold 226, which has an RBE.

Figure 91:
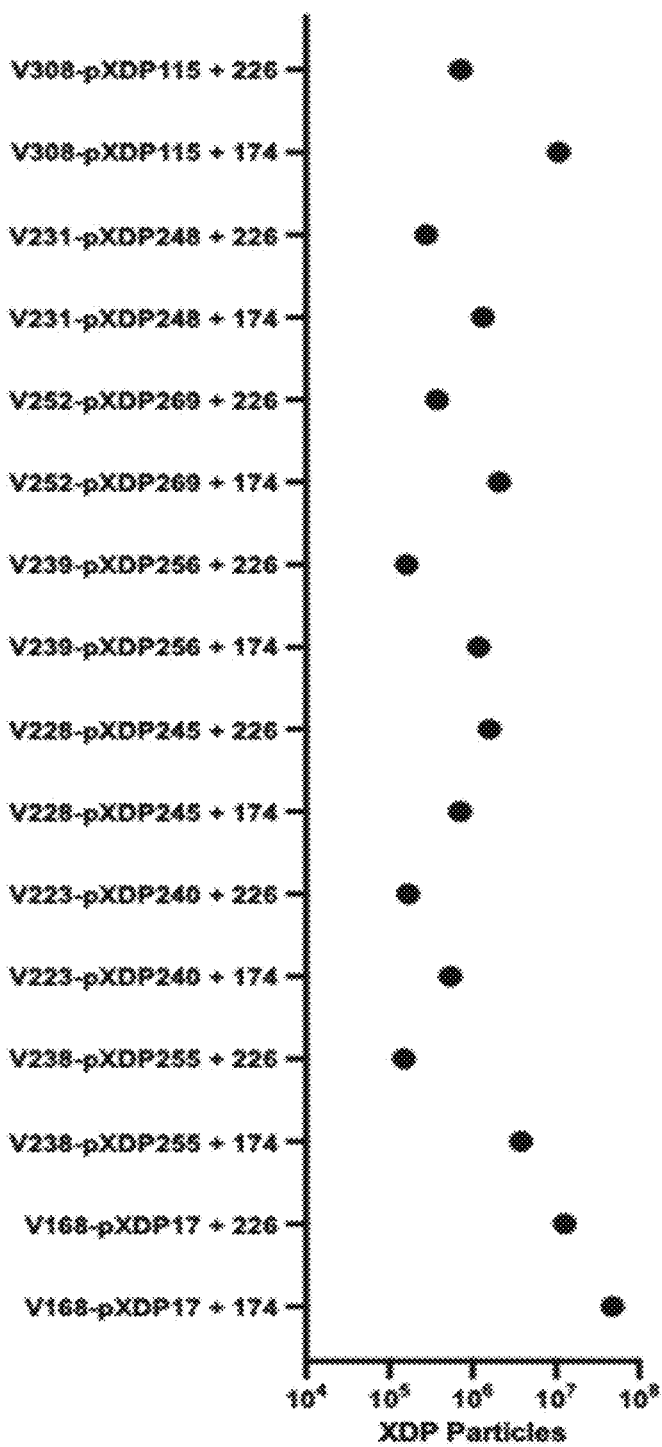

FIG. 91 is a scatterplot of EC50 values, based on the number of particles to achieve the EC50, for editing results with XDP constructs having various configurations of NLS linked to the CasX nuclease (or base control), with guide 226 (which has an RBE) or guide 174 (without an RBE), with the XDP used to edit tdTomato in NPCs across the indicated volumes of XDP added to treat the cells, as described in Example 26.

Figure 92:
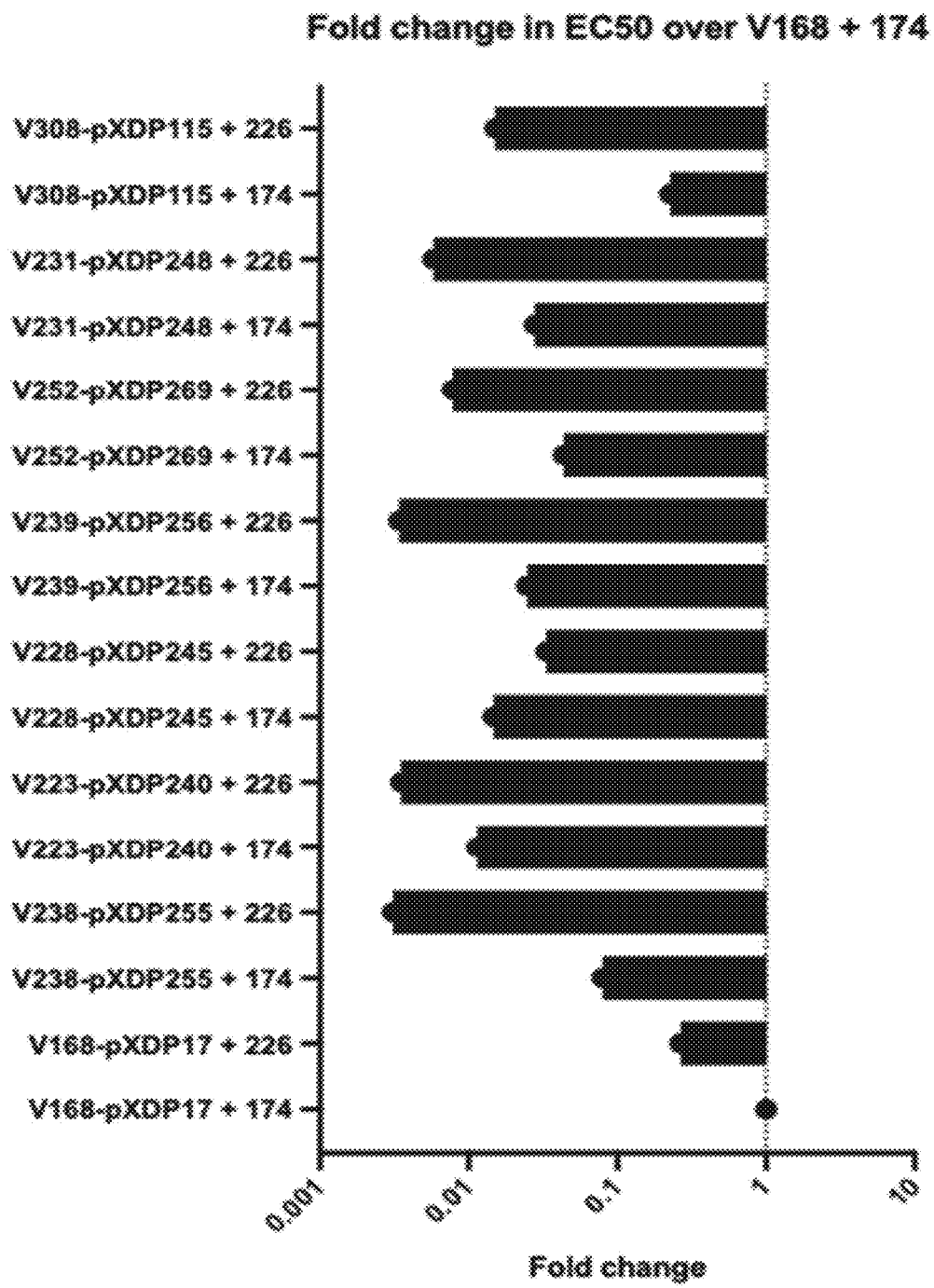

FIG. 92 is a bar chart showing the fold-change improvements in EC50 editing values of the NLS-configured XDP constructs and guide 226 (which has an RBE) or guide 174 (without an RBE), compared to the base control V168 and guide 174, for editing of TdTomato Neural progenitor cells, as described in Example 26.

Figure 93:
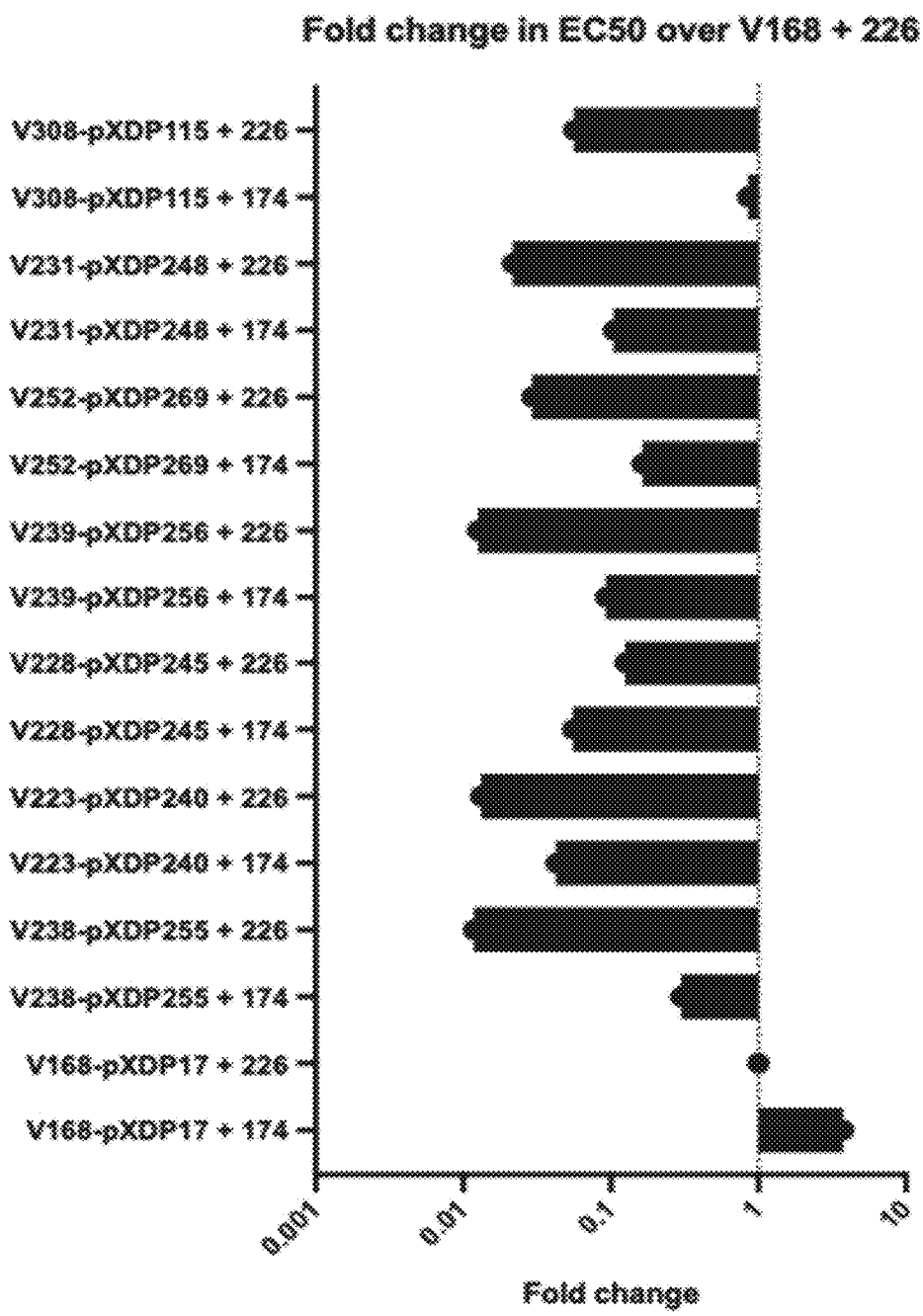

FIG. 93 is a bar chart showing the fold-change improvements in EC50 editing values of the NLS-configured XDP constructs and guide 226 (which has an RBE) or guide 174 (without an RBE) compared to the base control V168 and guide 226, for editing of tdTomato Neural progenitor cells, as described in Example 26.

Figure 94:
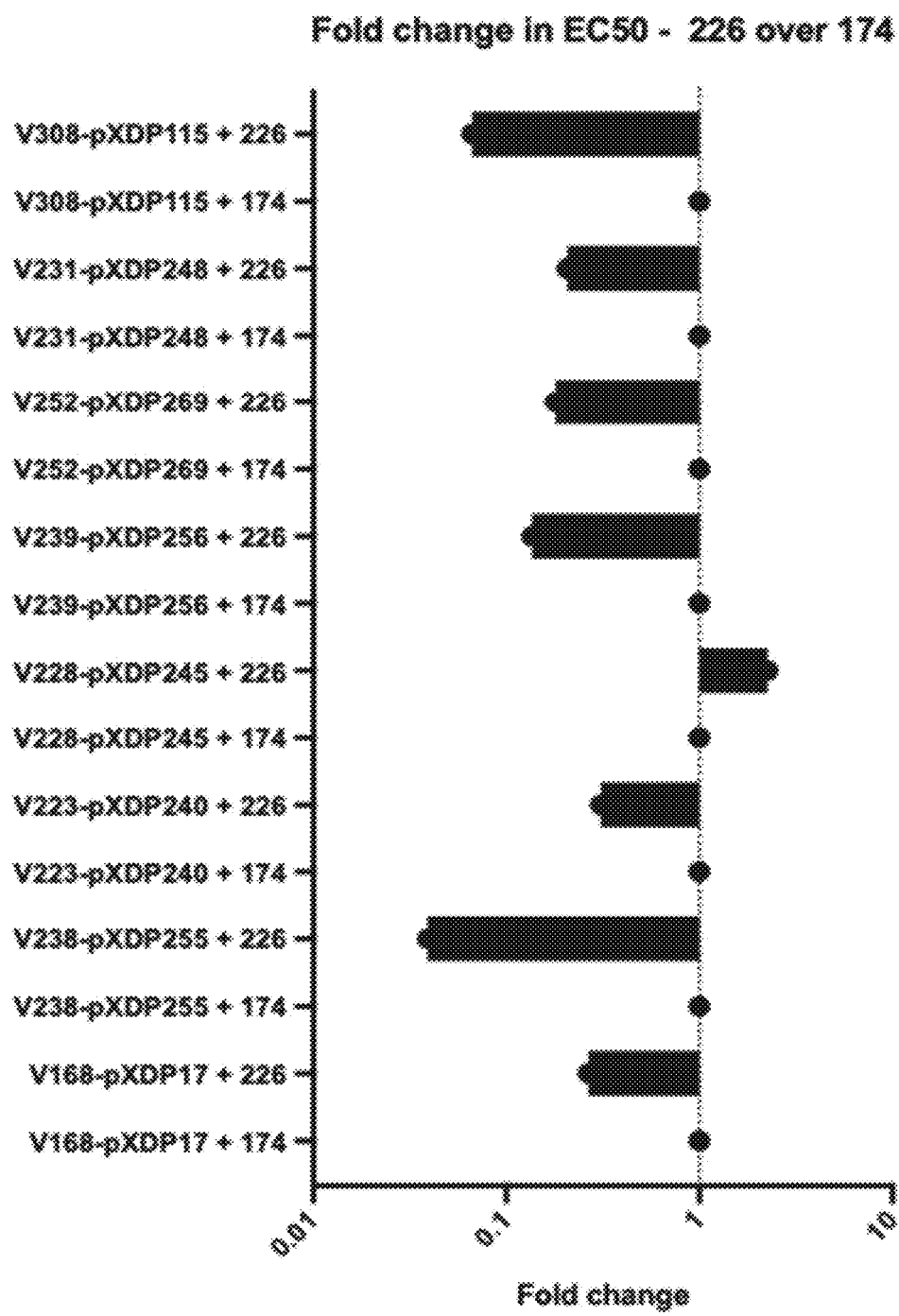

FIG. 94 is a bar chart showing the fold-change improvements in EC50 editing values of the NLS-configured XDP constructs with guide 226 (which has an RBE) compared to NLS-configured XDP constructs with guide 174 (which does not contain an RBE), for editing of tdTomato Neural progenitor cells, as described in Example 26, indicating a synergistic effect of the NLS and RBE.

Figure 95:
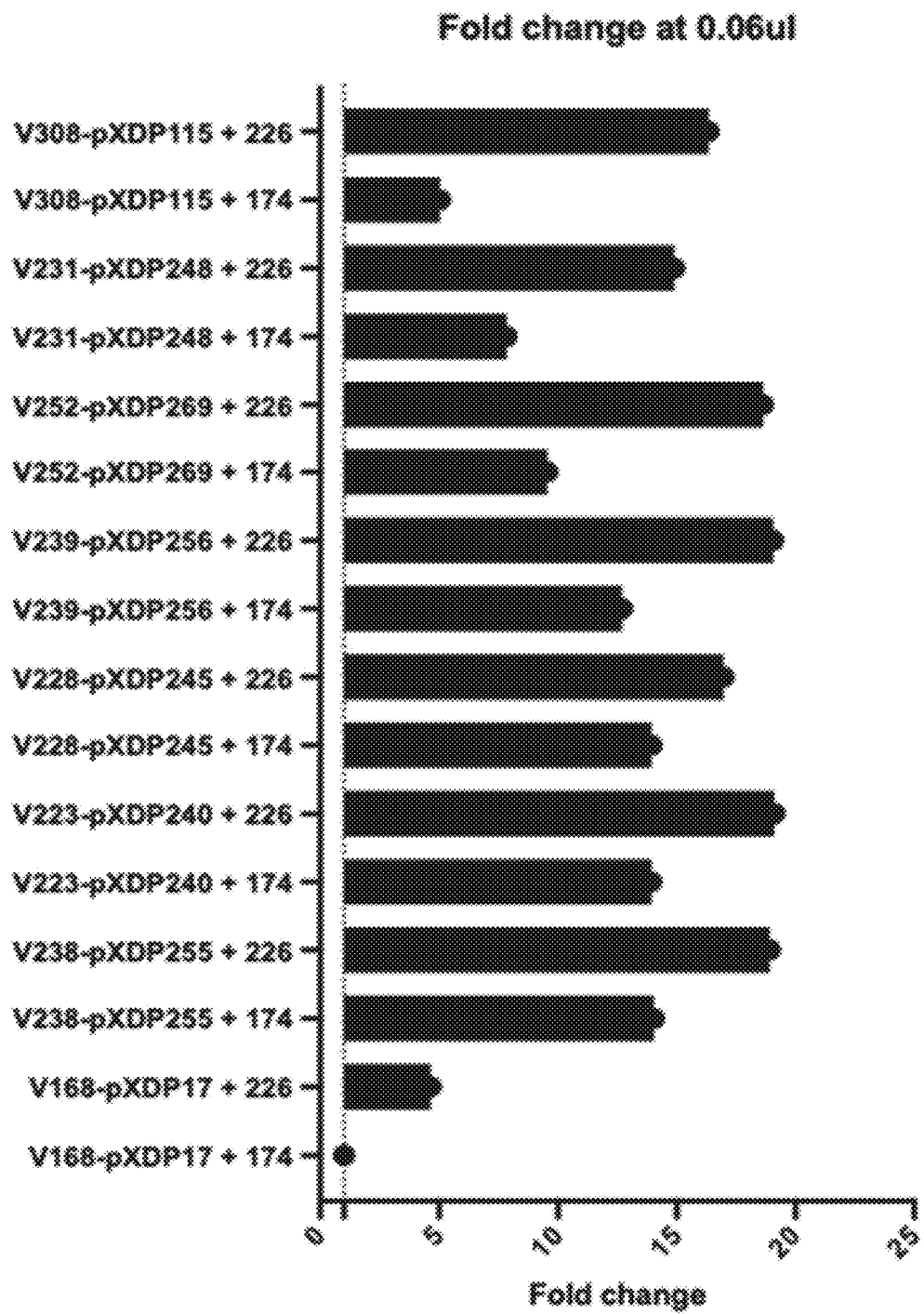

FIG. 95 is a bar chart showing the fold-change improvements in editing values of the NLS-configured XDP constructs with guide 226 (with an RBE) compared to NLS-configured XDP constructs with guide 174 (which does not contain an RBE), at a volume of 0.06 µl for editing of tdTomato Neural progenitor cells, as described in Example 26.

Figure 96:
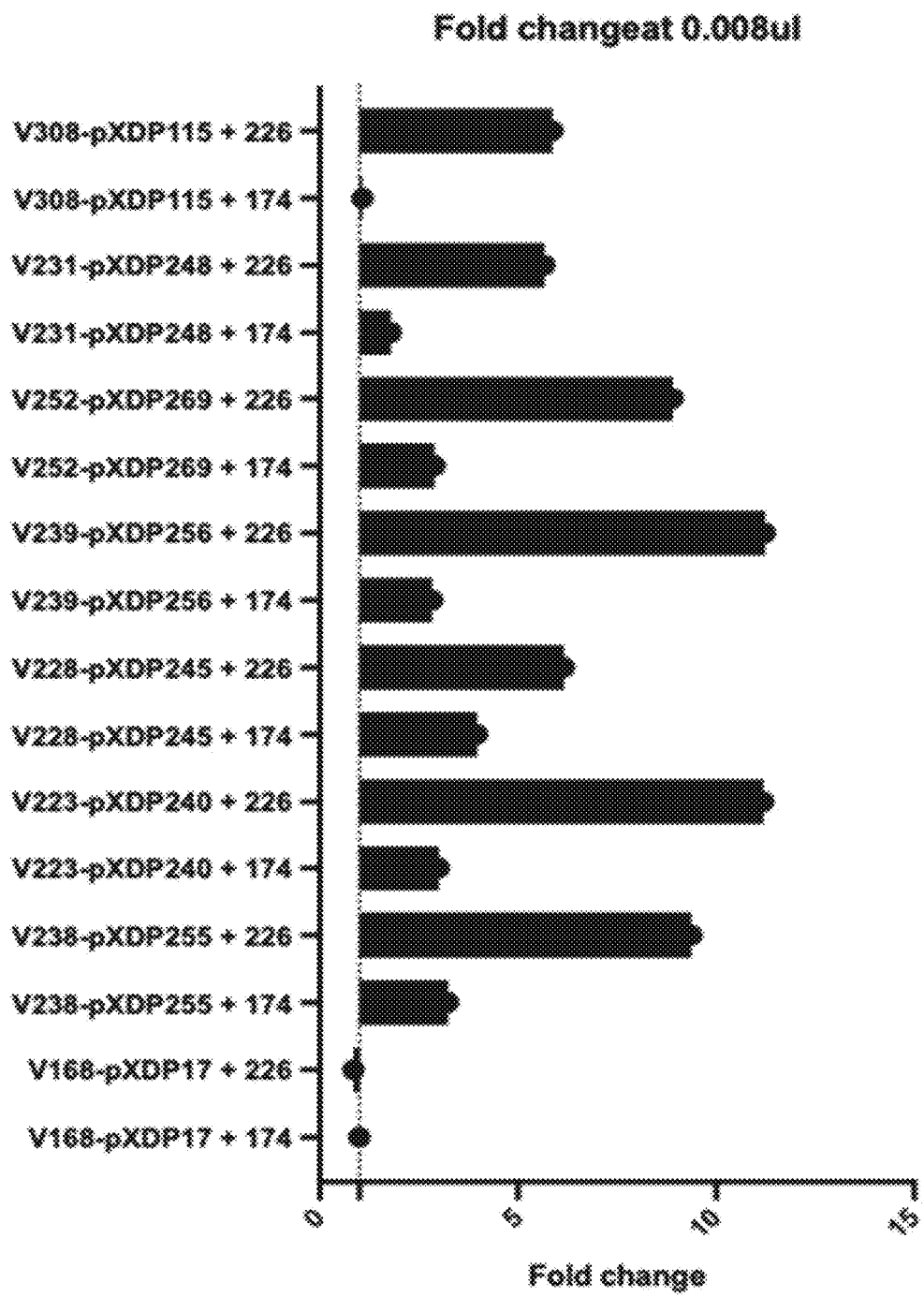

FIG. 96 is a bar chart showing the fold-change improvements in editing values of the NLS-configured XDP constructs with guide 226 (with an RBE) compared to NLS-configured XDP constructs with guide 174 (which does not contain an RBE), at a volume of 0.008 µl for editing of tdTomato Neural progenitor cells, as described in Example 26.

Figure 97:

FIG. 97 is a bar chart showing the fold-change improvements in editing values of the NLS-configured XDP constructs with guide 226 (with an RBE) compared to NLS-configured XDP constructs with guide 174 (which does not contain an RBE), at a volume of 0.023 µl for editing of TdTomato Neural progenitor cells, as described in Example 26.

Figure 98:
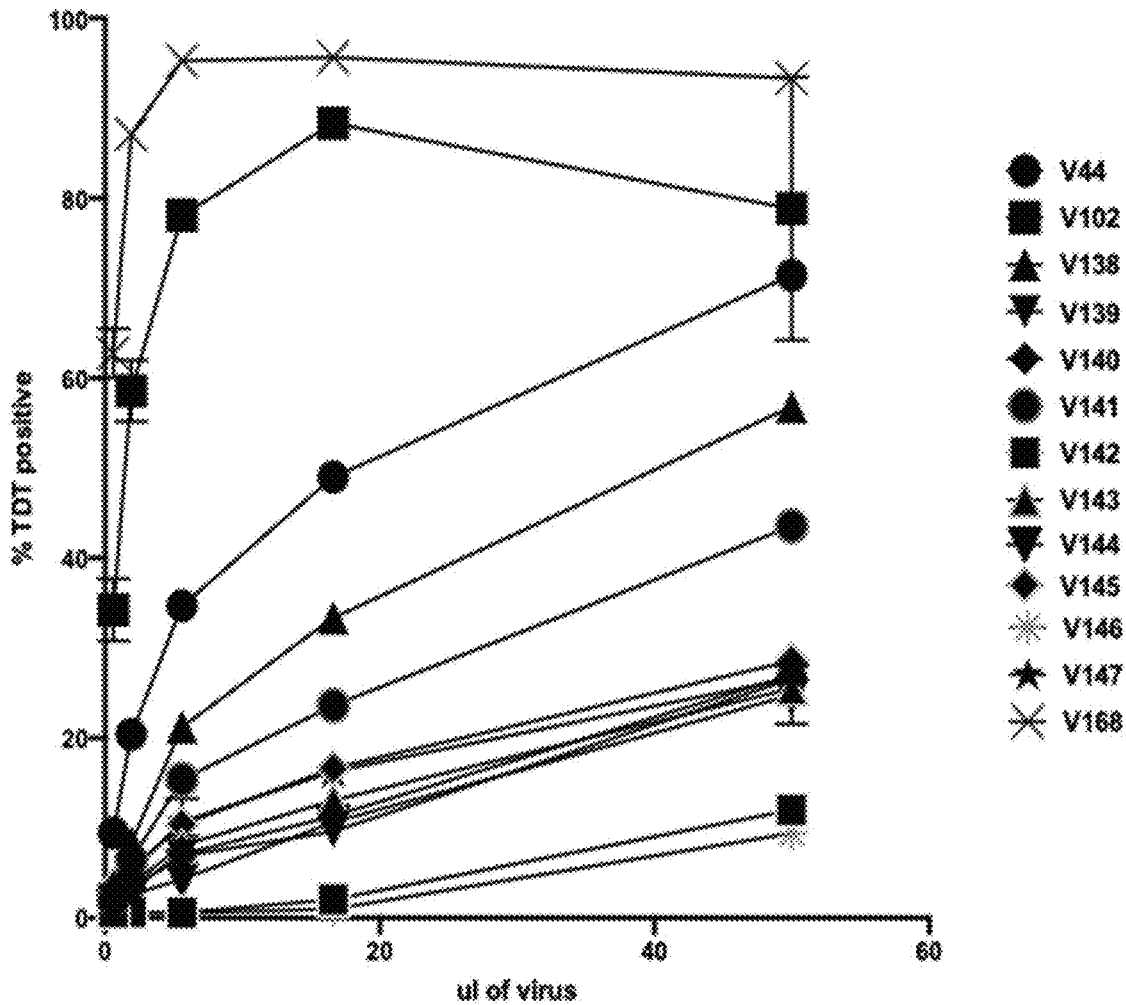

FIG. 98 is a graph of percent editing of tdTomato NPCs evaluating XDP constructs based on Gag-pro and Gag polyproteins derived from different Alpharetroviruses, used across the range of volumes indicated, as described in Example 28.

Figure 99:
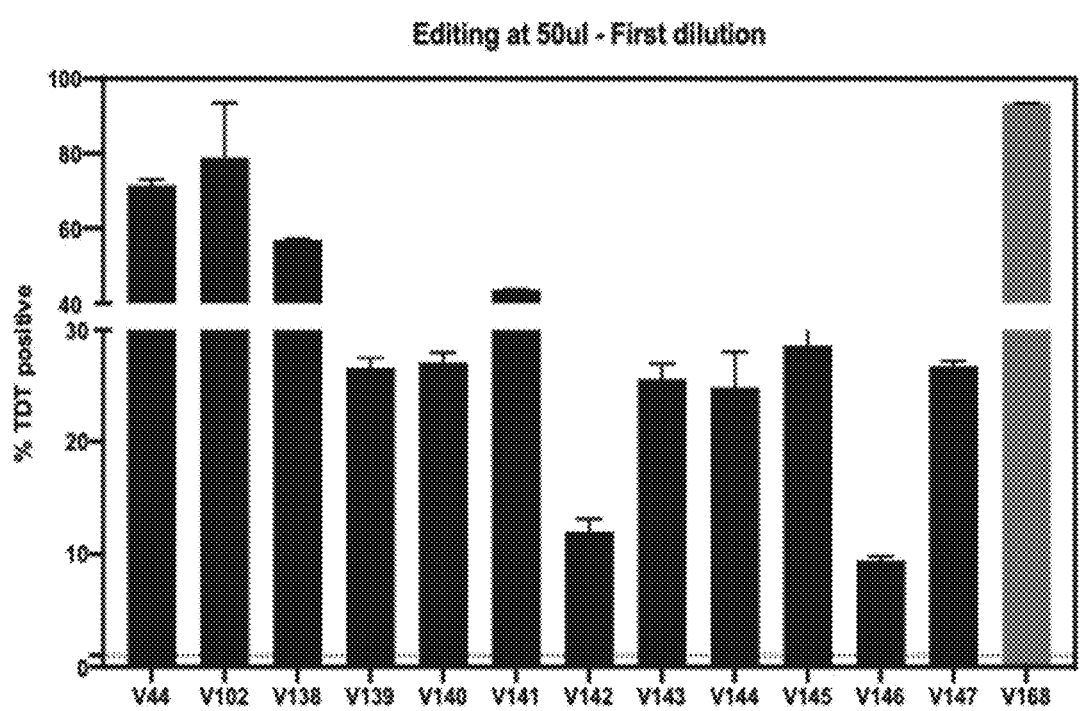

FIG. 99 is a bar chart of percent editing of tdTomato NPCs evaluating XDP constructs based on Gag-pro and Gag polyproteins derived from different Alpharetroviruses, used at the indicated volume, as described in Example 28.

Figure 100:
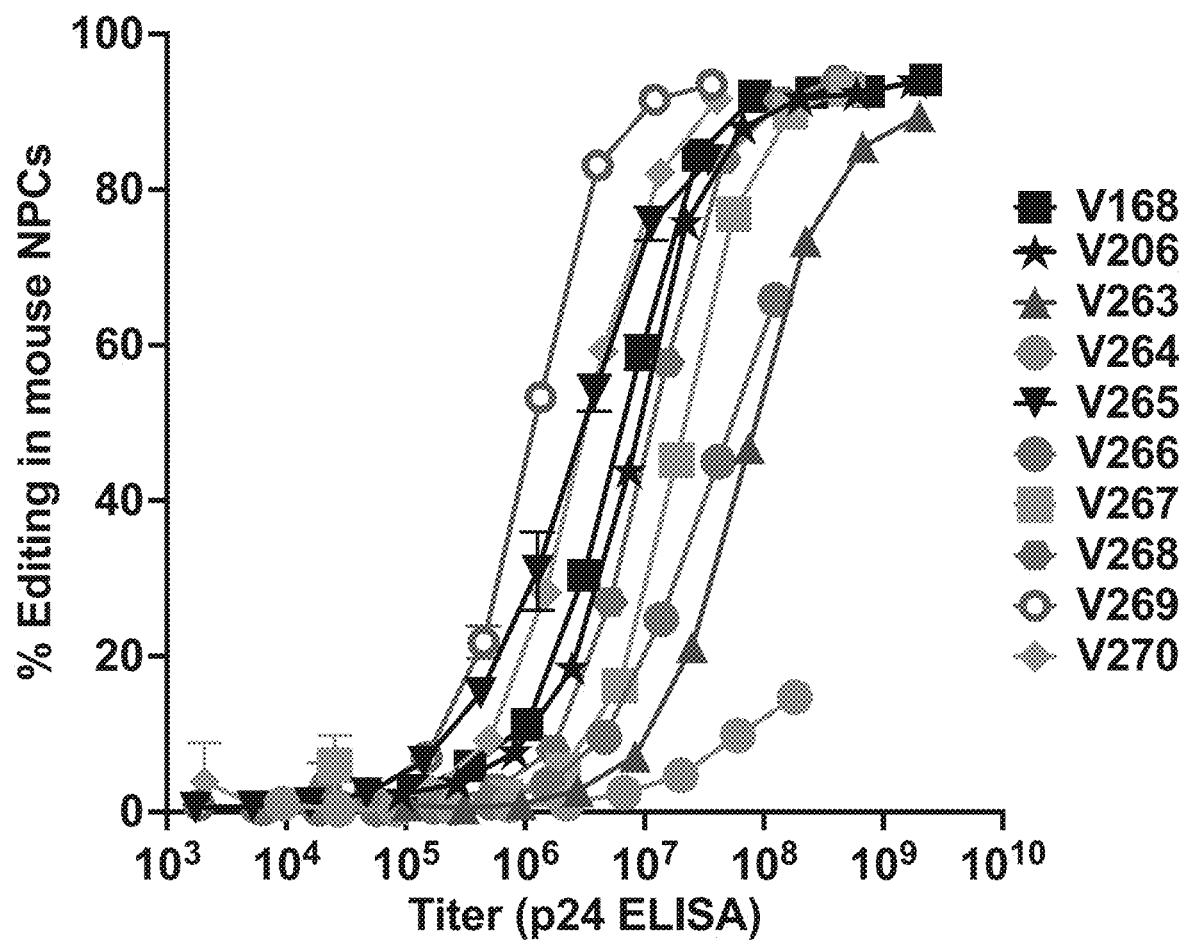

FIG. 100 is a graph of percent editing results of tdTomato NPCs by XDP constructs having MS2 coat protein incorporated in various locations within the Gag polypeptide plasmid, compared to the Version 168 control, with results presented at percent editing across the range of concentrations tested (determined by p24 ELISA), as described in Example 13.

Figure 101:
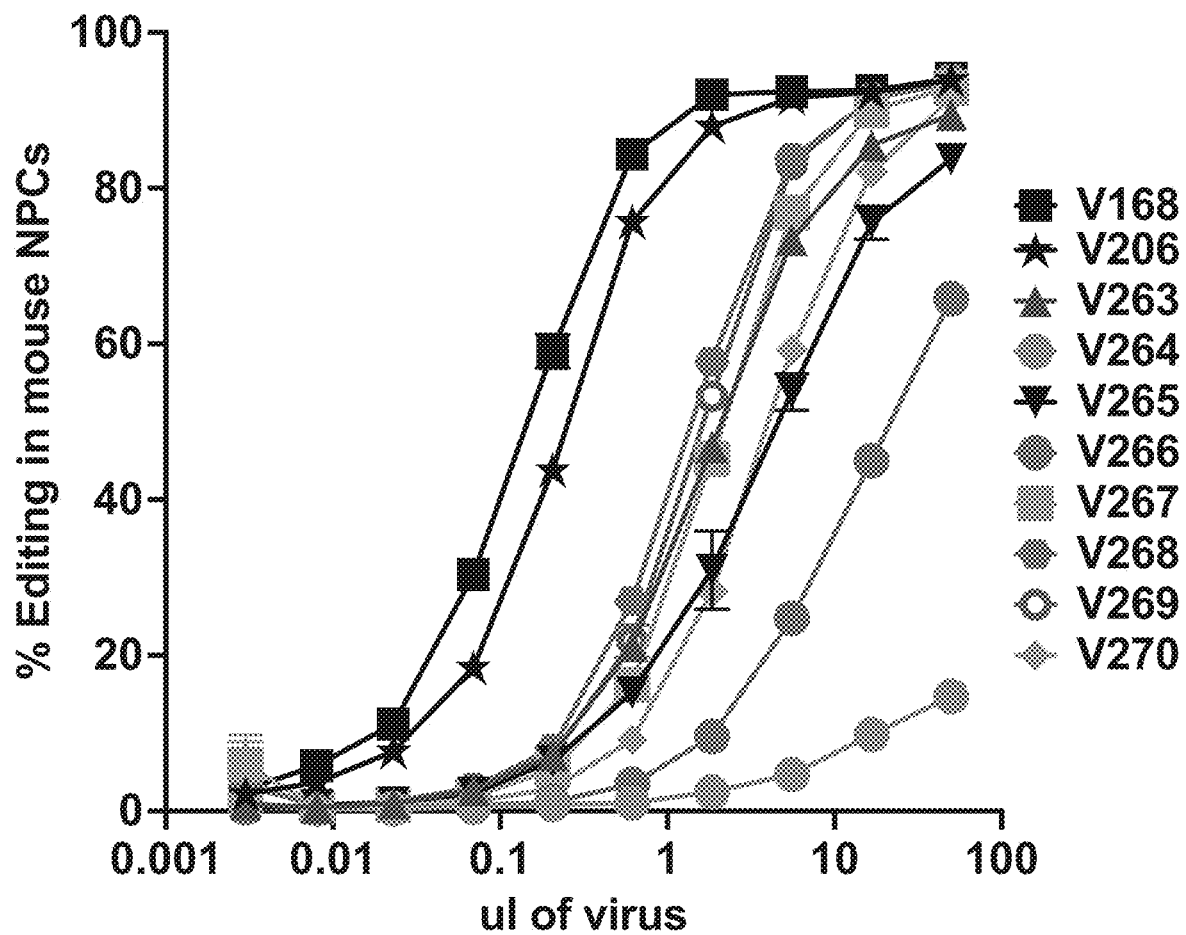

FIG. 101 is a graph of percent editing results of tdTomato NPCs by XDP constructs having MS2 coat protein incorporated in various locations within the Gag polypeptide plasmid, compared to the Version 168 control, with results presented at percent editing across the range of volumes of XDP tested, as described in Example 13.

Figure 102:
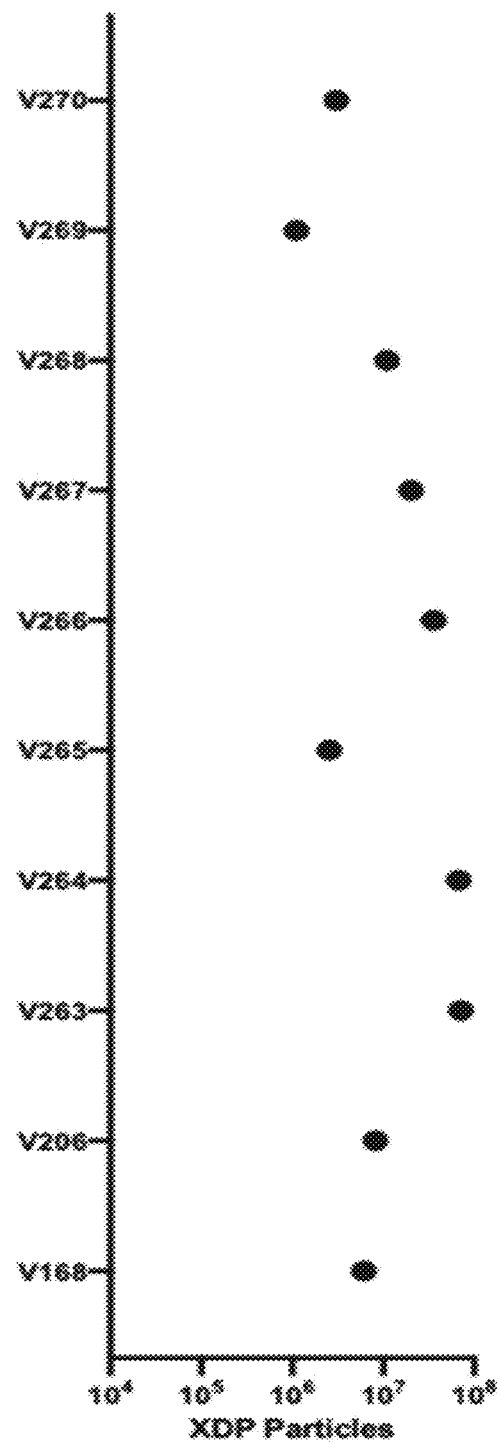

FIG. 102 is a scatterplot of EC50 values achieved by the indicated number of XDP particles for editing of the tdTomato NPCs by XDP constructs having MS2 coat protein incorporated in various locations within the Gag polypeptide plasmid, compared to the Version 168 control, as described in Example 13.

Figure 103:
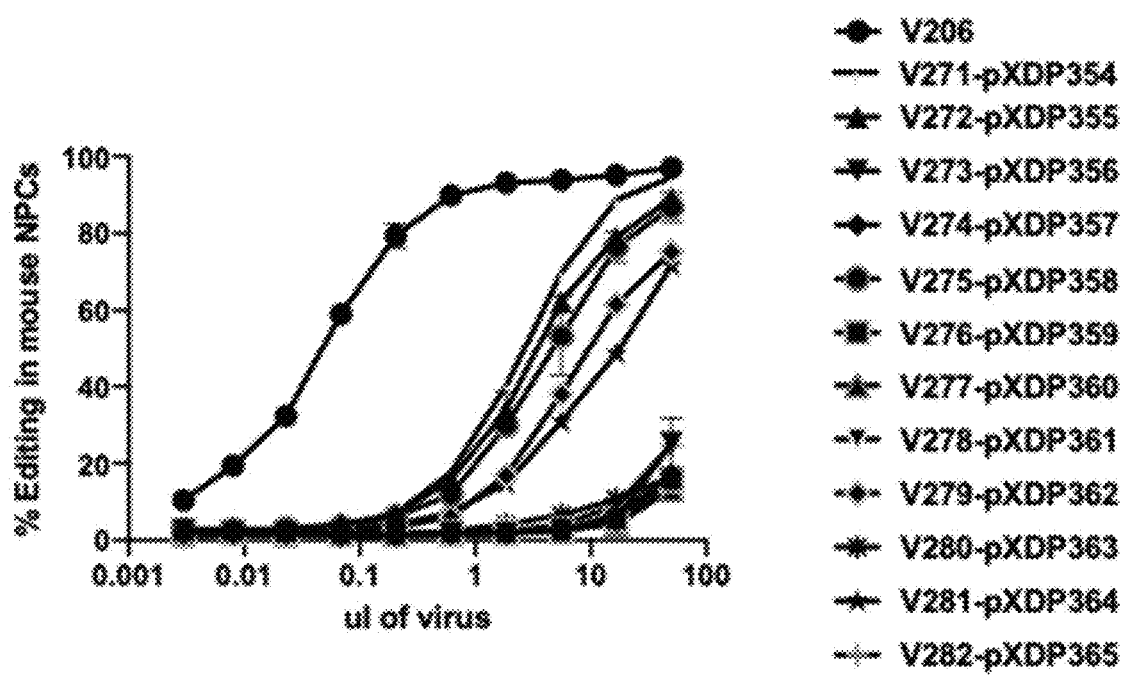

FIG. 103 is a graph of percent editing results of tdTomato NPCs by XDP constructs having MS2 coat protein incorporated in within the Gag or Gag-Pro polypeptide plasmid, compared to control construct version 206, with results presented at percent editing across the range of volumes of XDP tested, as described in Example 14.

Figure 104:
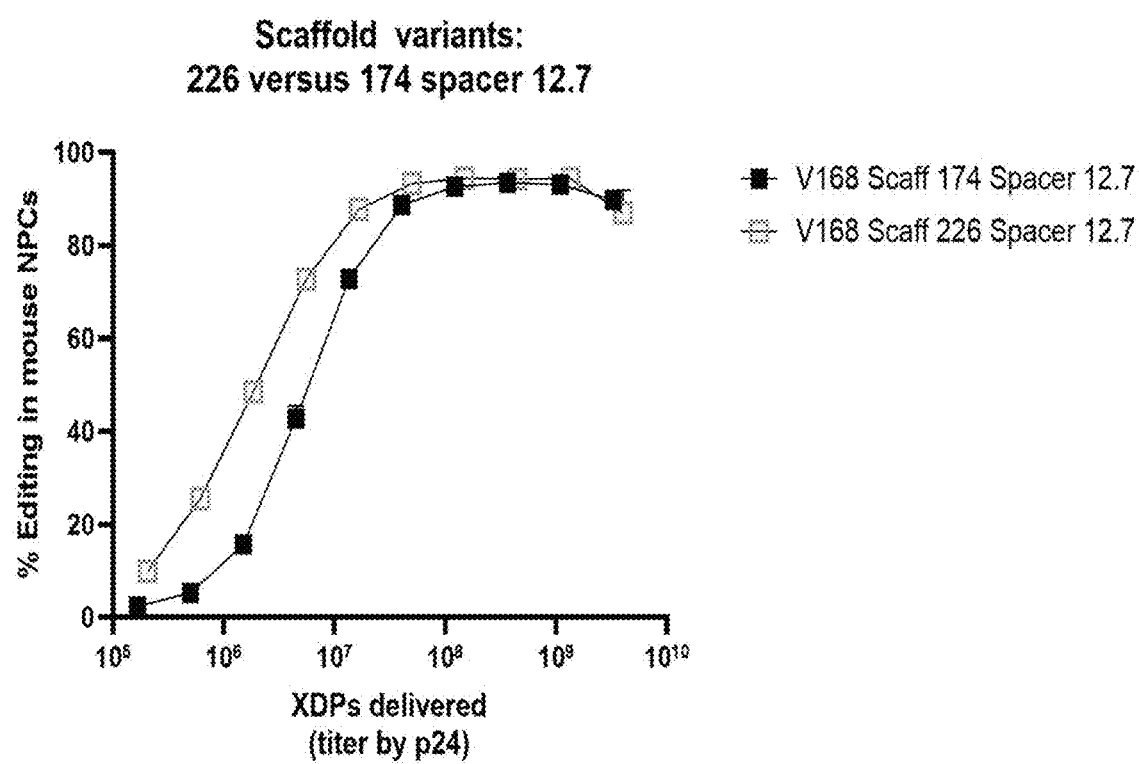

FIG. 104 is a graph of percent editing results of tdTomato NPCs by XDP having the incorporation of a portion of an RRE sequence into the guide RNA scaffold (scaffold 226) with spacer 12.7 (targeting tdTomato), compared to guide RNA scaffold 174 as control, as described in Example 24.

Figure 105:
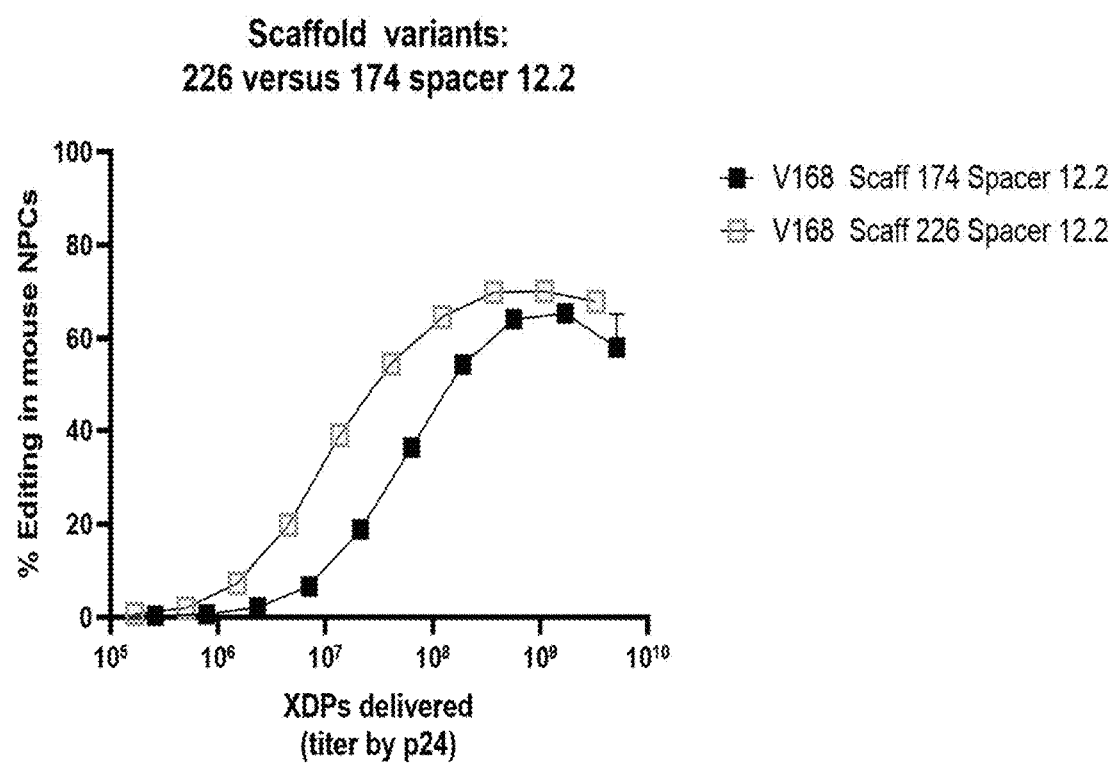

FIG. 105 is a graph of percent editing results of tdTomato NPCs by XDP having the incorporation of a portion of an RRE sequence into the guide RNA scaffold (scaffold 226) with spacer 12.2 (targeting tdTomato), compared to guide RNA scaffold 174 as control, as described in Example 24.

Figure 106:
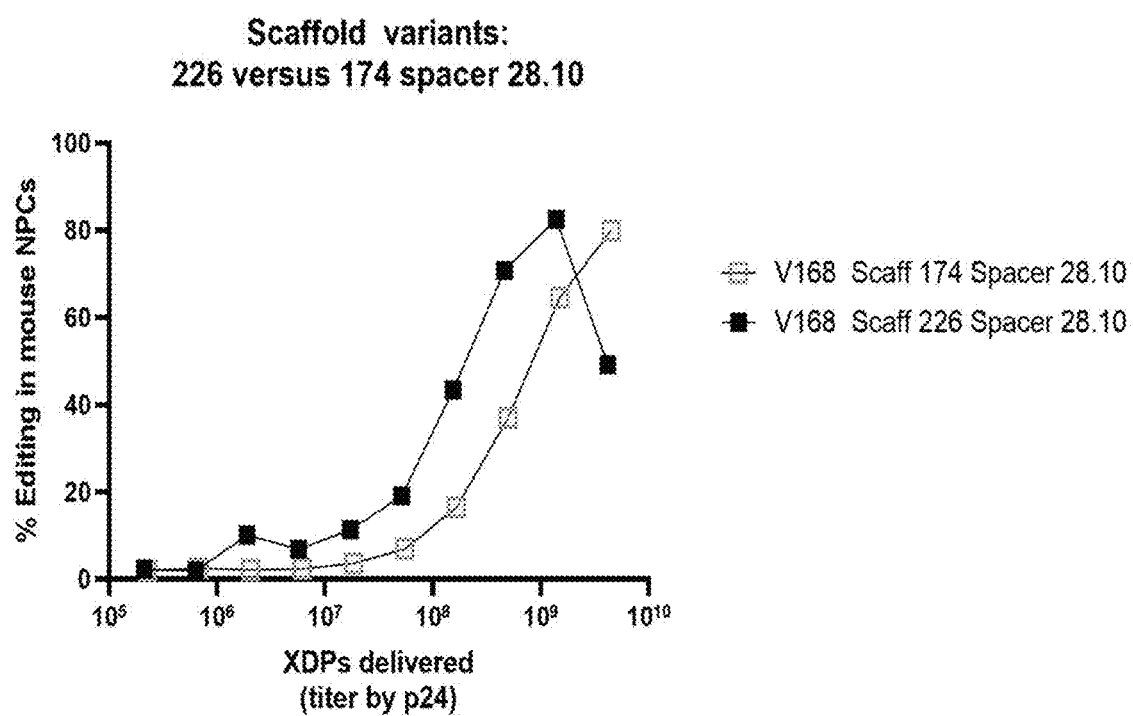

FIG. 106 is a graph of percent editing results (by NGS) of NPCs by XDP having the incorporation of a portion of an RRE sequence into the guide RNA scaffold (scaffold 226) with spacer 28.10 (targeting PTBP1), compared to guide RNA scaffold 174 as control, as described in Example 24.

Figure 107:
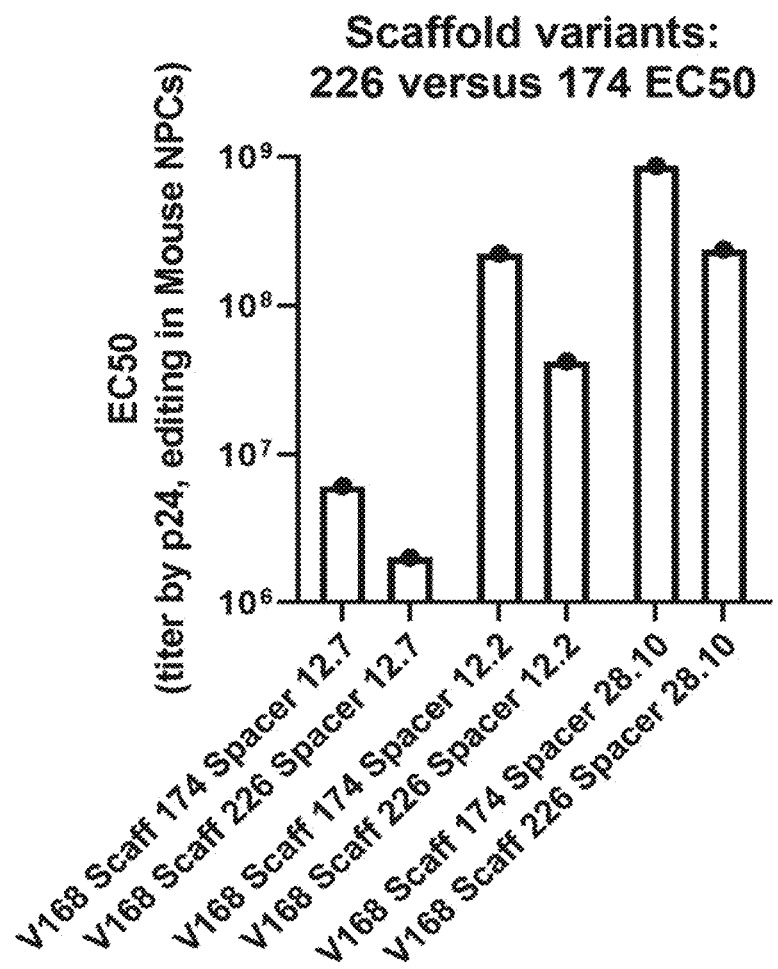

FIG. 107 is a bar chart of the EC50 values determined from the assays portrayed in FIGS. 104-106, as described in Example 24.

Figure 108:
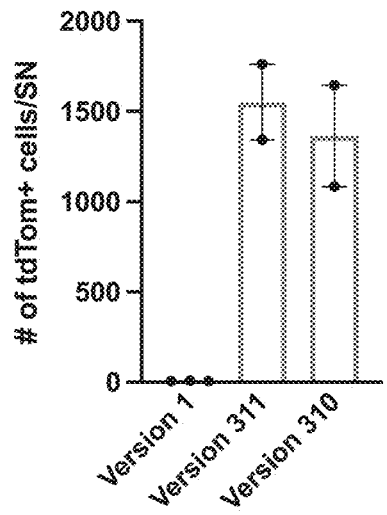

FIG. 108 is a bar graph of the number of tdTomato+ cells in the Substantia Nigra with Version 1, Version 310, or Version 311 XDPs, as described in Example 29.

Figure 109:
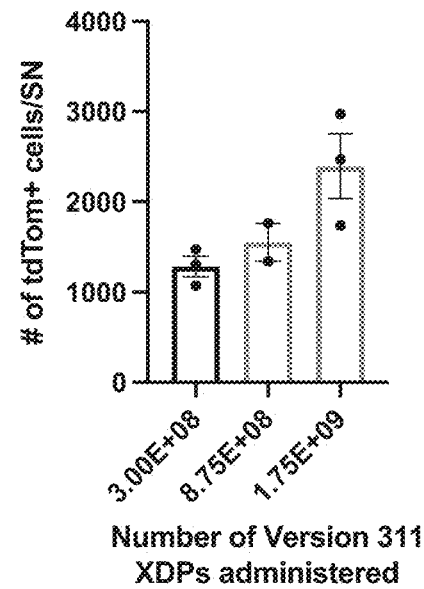

FIG. 109 is a bar graph of the number of tdTomato+ cells in the Substantia Nigra with different doses of Version 311 XDPs, as described in Example 29.

Figure 10:
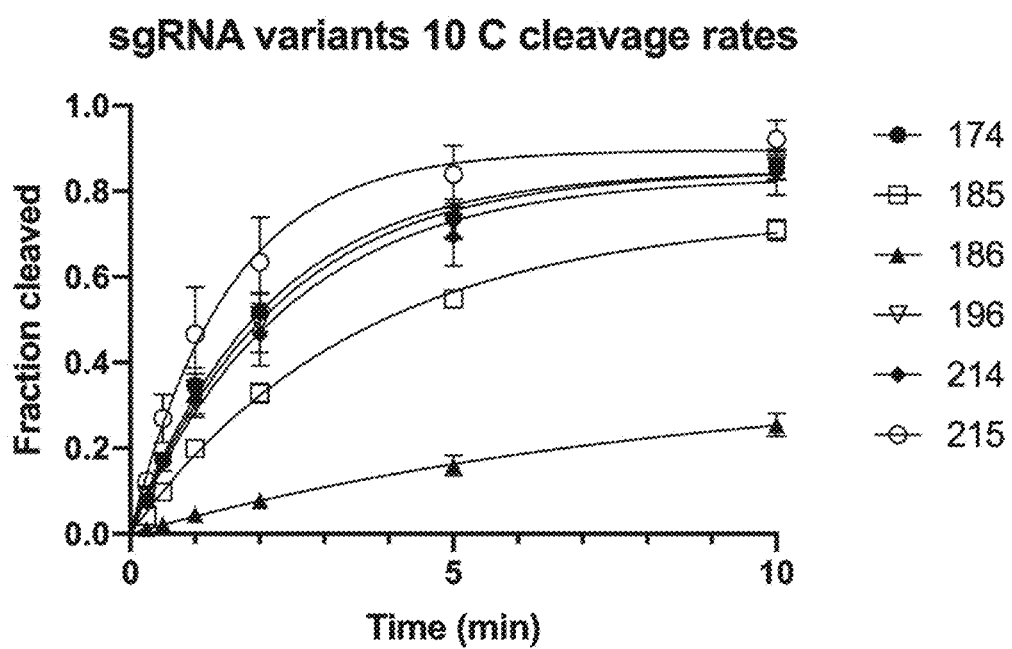
FIG. 10 shows the quantification of cleavage rates of RNP formed by CasX491 and the sgRNA variants, as described in Example 4. Target DNA was incubated with a 20-fold excess of the indicated RNP at 10° C. and the amount of cleaved target was determined at the indicated time points. The monophasic fit of the timepoints is shown.

FIG. 110 is a schematic illustrating the positions of the bases within the MS2 hairpin, as described in Example 30. The sequence in FIG. 10 is ACAUGAGGAUCACC-CAUGU (SEQ ID NO: 35173).

Figure 111:
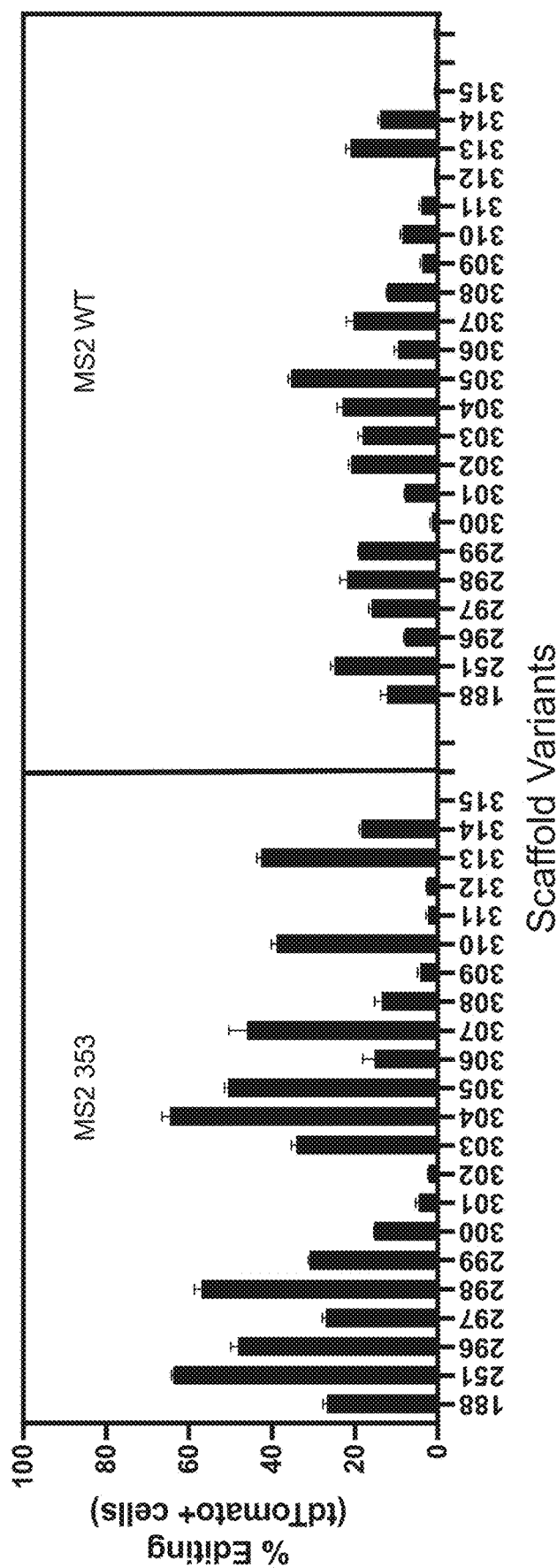

FIG. 111 is a bar graph of percent editing at the tdTomato locus measured by tdTomato fluorescence for XDPs packaged with the indicated scaffold variants, with gRNA scaffold 188 and 251 serving as base variants. Two MS2 versions (MS2 353 and MS2 WT) were used.

Figure 112:
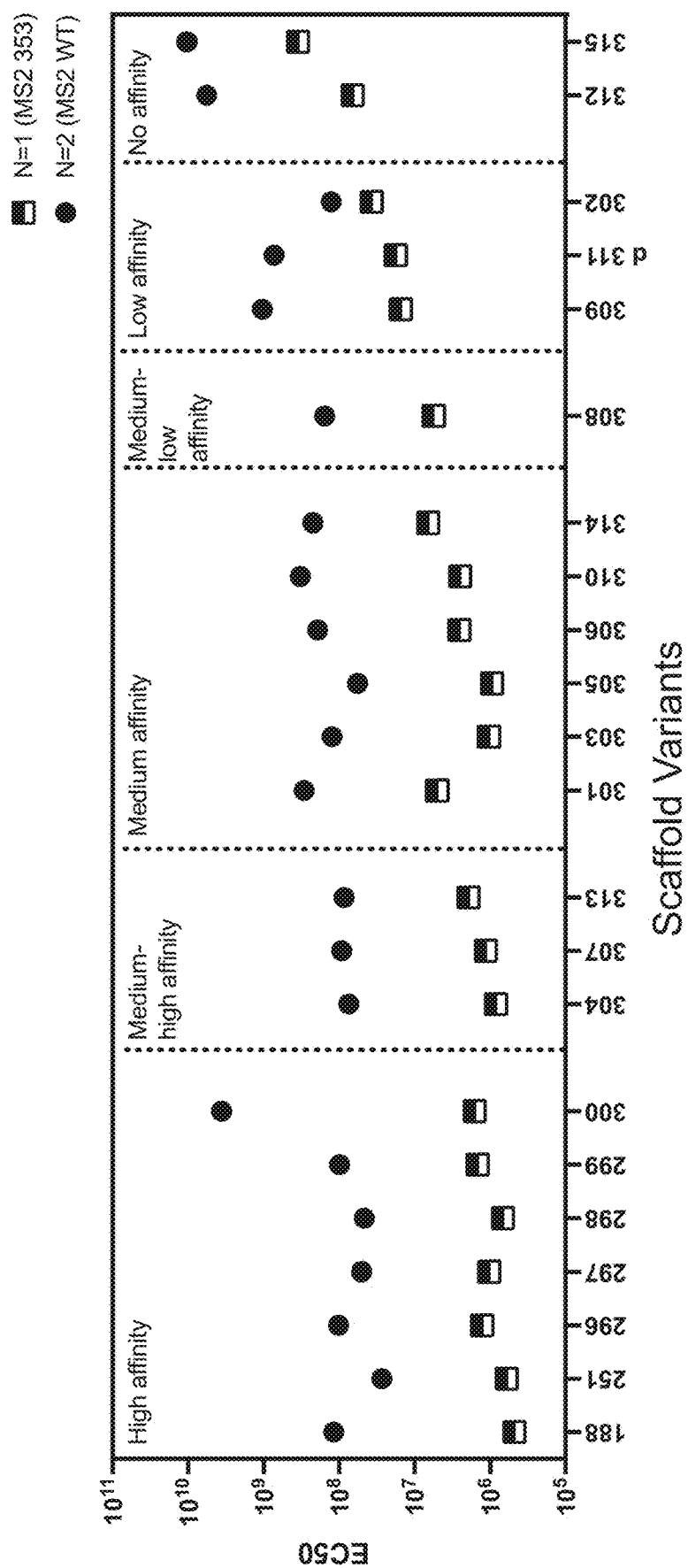

FIG. 112 is a plot that shows the improvements in EC50 values, determined using the NanoSight, for editing at the tdTomato locus in NPCs, relative to titers, for XDPs packaged with the indicated gRNA scaffold variants, with Scaffold 188 and 251 serving as base controls. Two MS2 versions, MS2 353 and MS2 WT, were used.

Figure 113:
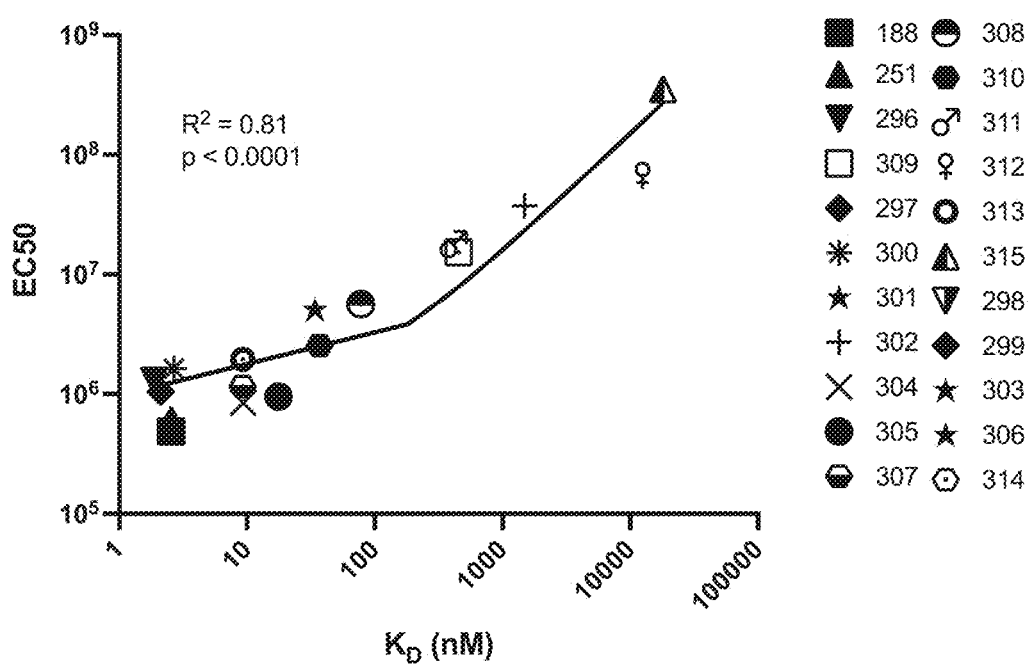

FIG. 113 is a plot that shows the correlation between MS2 hairpin affinity ($K_D$) and EC50 for XDPs packaged with the depicted gRNA scaffold variants.

Figure 114:
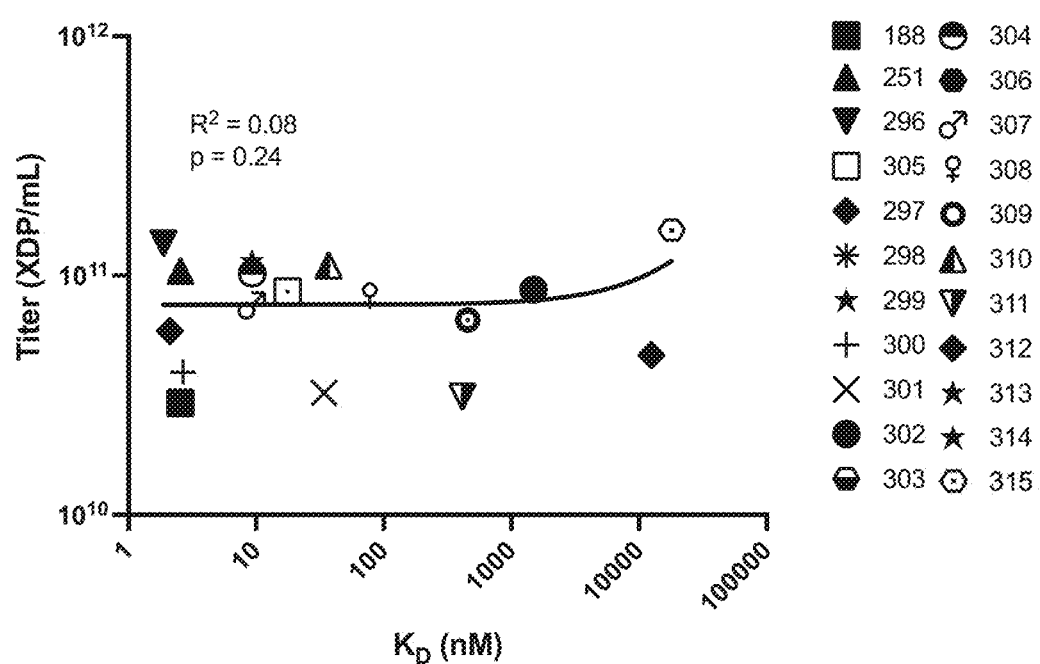

FIG. 114 is a plot that shows the correlation between MS2 hairpin affinity ($K_D$) and titer for XDPs packaged with the depicted gRNA scaffold variants.

FIG. 115 shows Table 10, a table of viral DNA sequences.

Figure 116:
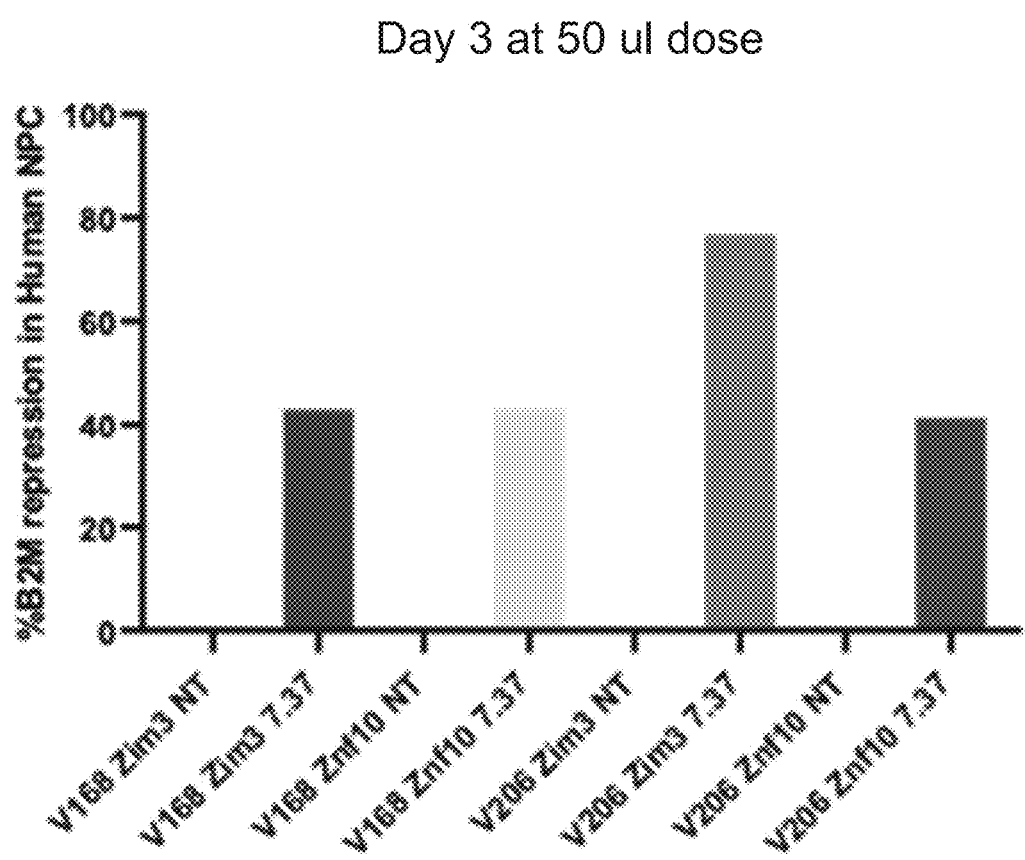

FIG. 116 is a bar graph of repression results with XDPs carrying catalytically-dead CasX repressors (dXRs) used to repress the B2M locus in human NPCs, as described in Example 32.

Figure 117:
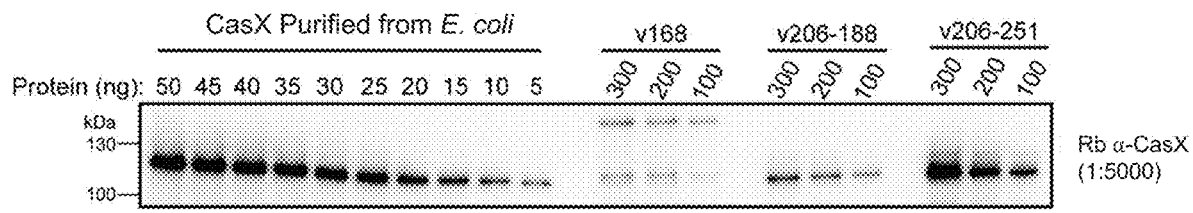

FIG. 117 shows an image of a Western blot for CasX in various XDPs, as described in Example 33.

Figure 118:
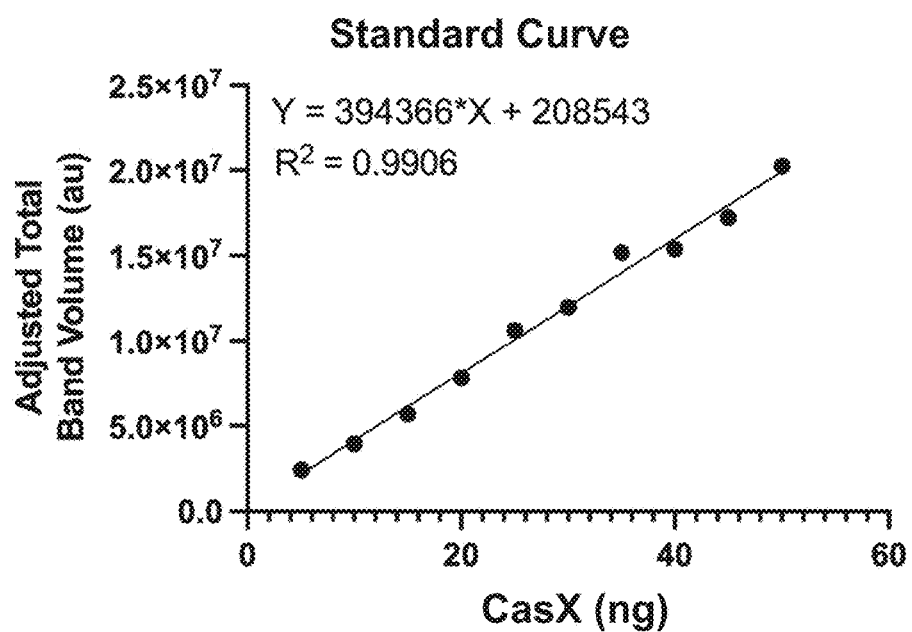

FIG. 118 is a plot of a standard curve of a Western blot measuring the amount of CasX in various XDPs, as described in Example 33.

Figure 119:
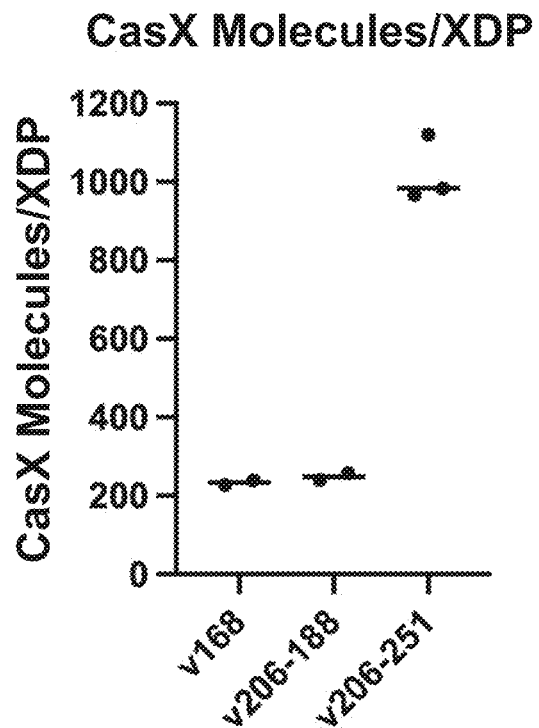

FIG. 119 is a plot showing the number of CasX molecules per XDP in various XDPs, as described in Example 33.

Figure 120:
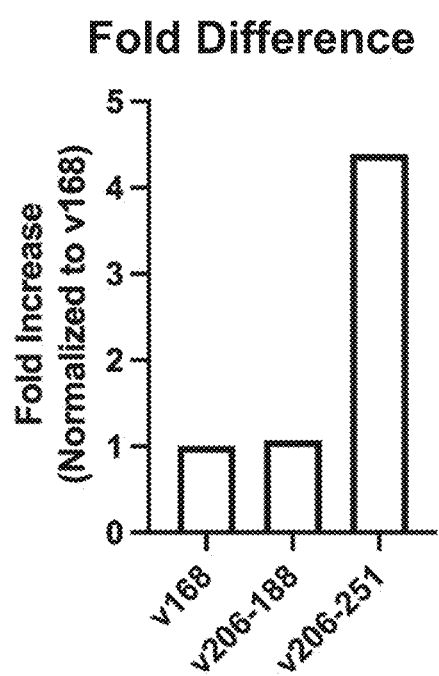

FIG. 120 is a bar graph showing the fold difference in the number of CasX molecules per XDP particle in various XDPs relative to version 168, as described in Example 33.

Figure 121:
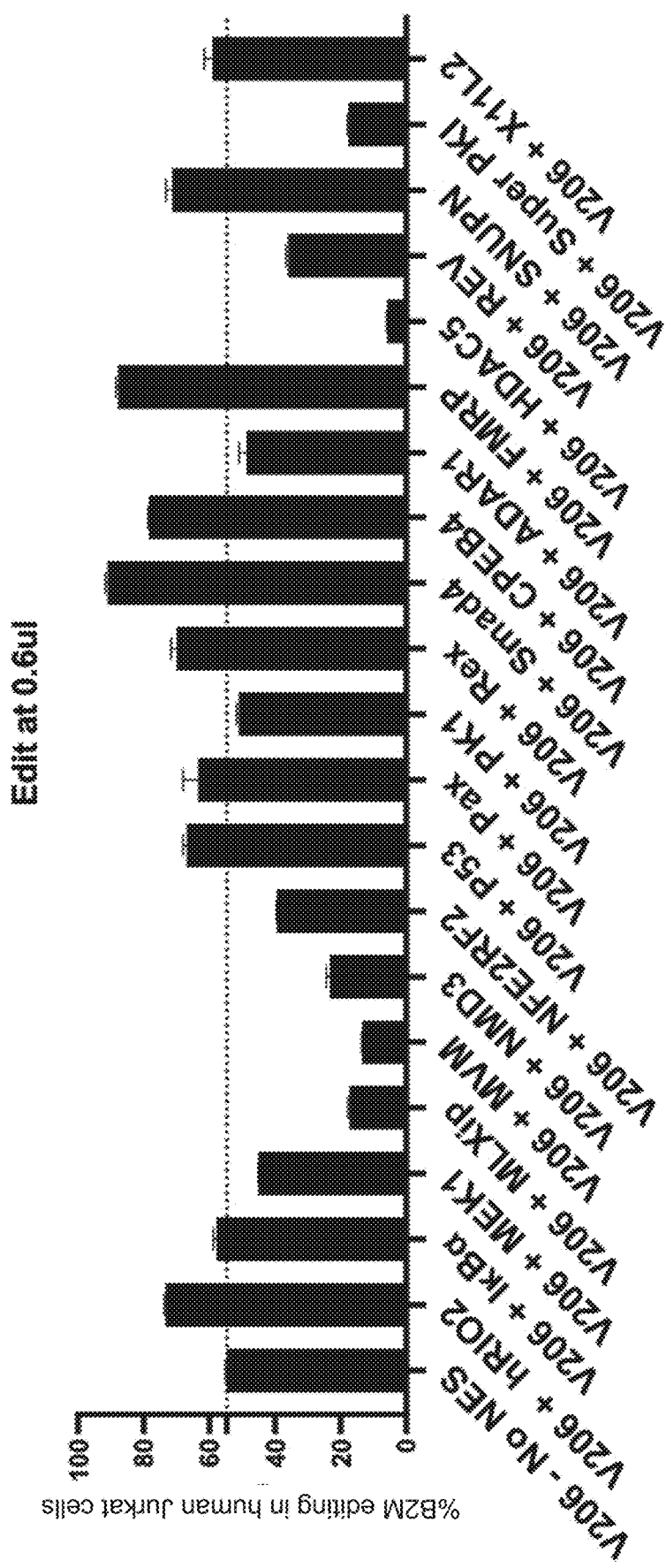

FIG. 121 is a bar graph of editing results with XDPs having various nuclear export signal (NES) sequences linked to CasX used to edit the B2M locus in Jurkat cells, as described in Example 34.

Figure 122:
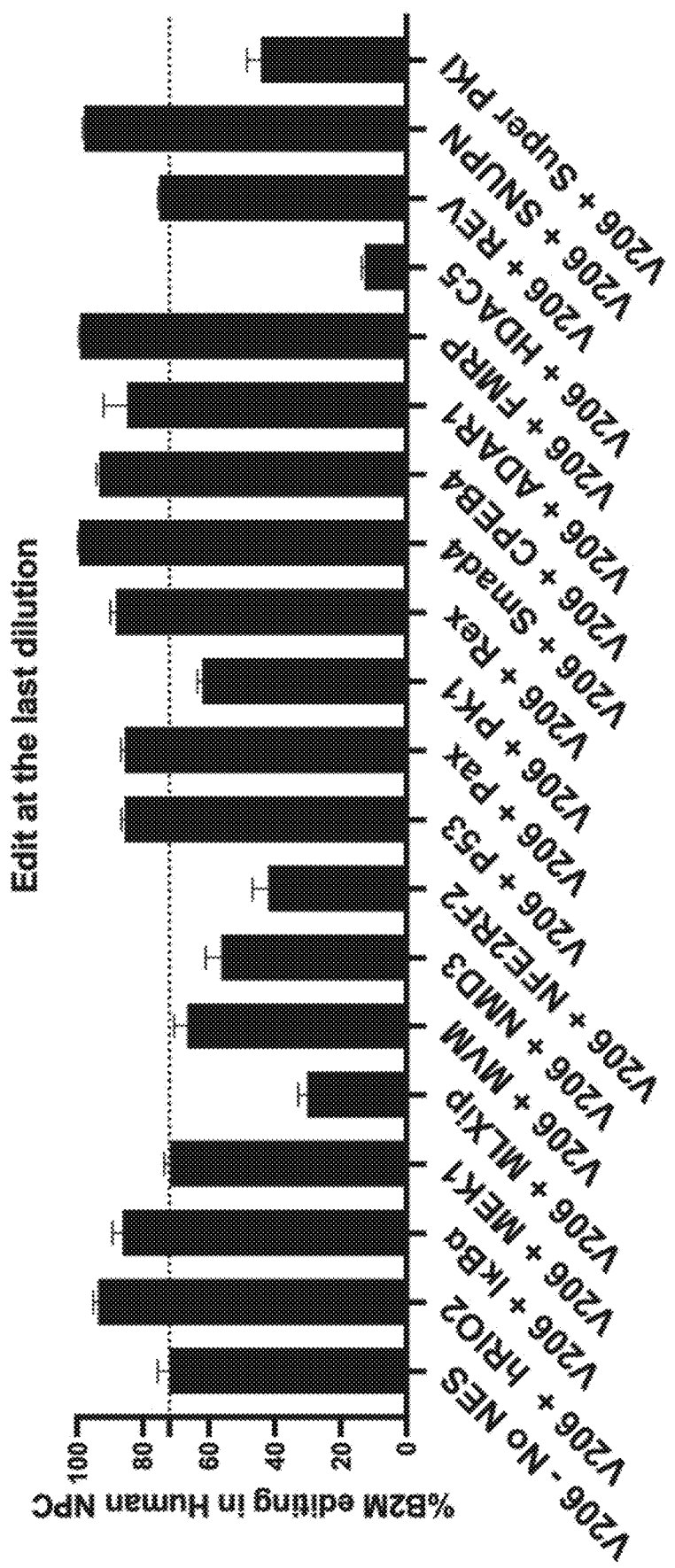

FIG. 122 is a bar graph of editing results with XDPs having various nuclear export signal (NES) sequences linked to CasX used to edit the B2M locus in human NPCs, as described in Example 34.

Figure 123:
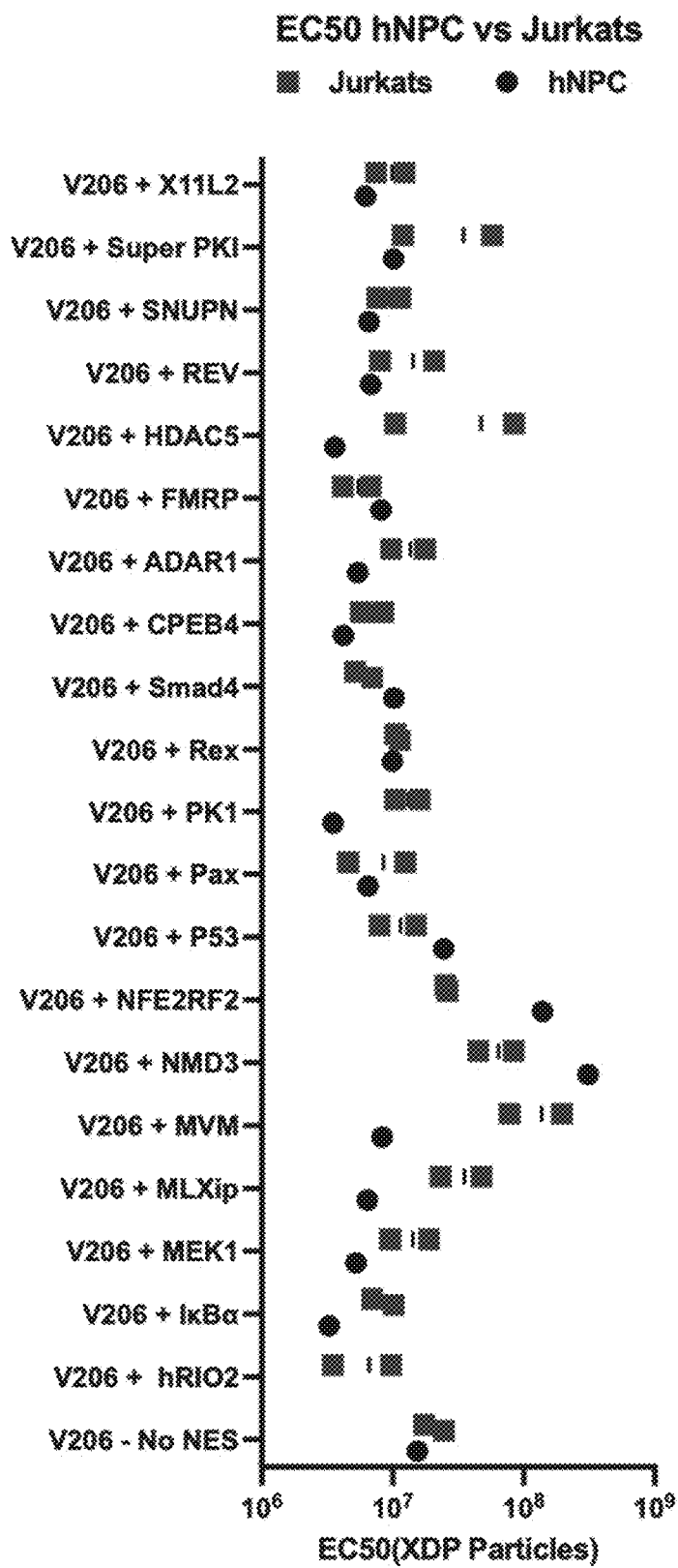

FIG. 123 is a scatterplot of EC50 values, based on the number of particles to achieve the EC50, for editing results with XDP constructs having various NES sequences linked to CasX, as described in Example 34.

Figure 124:
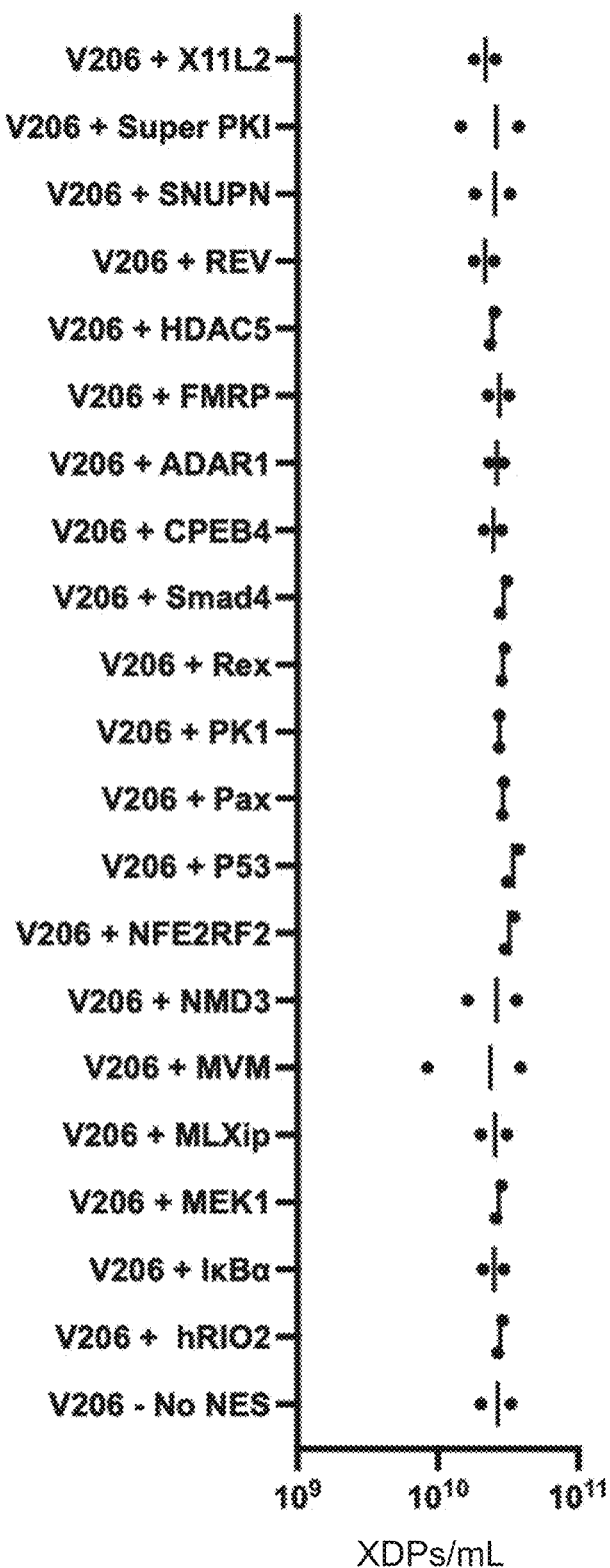

FIG. 124 is a plot showing the titers for the XDP constructs with various NES sequences linked to CasX, as described in Example 34. All constructs showed comparable levels of production.

Figure 125:
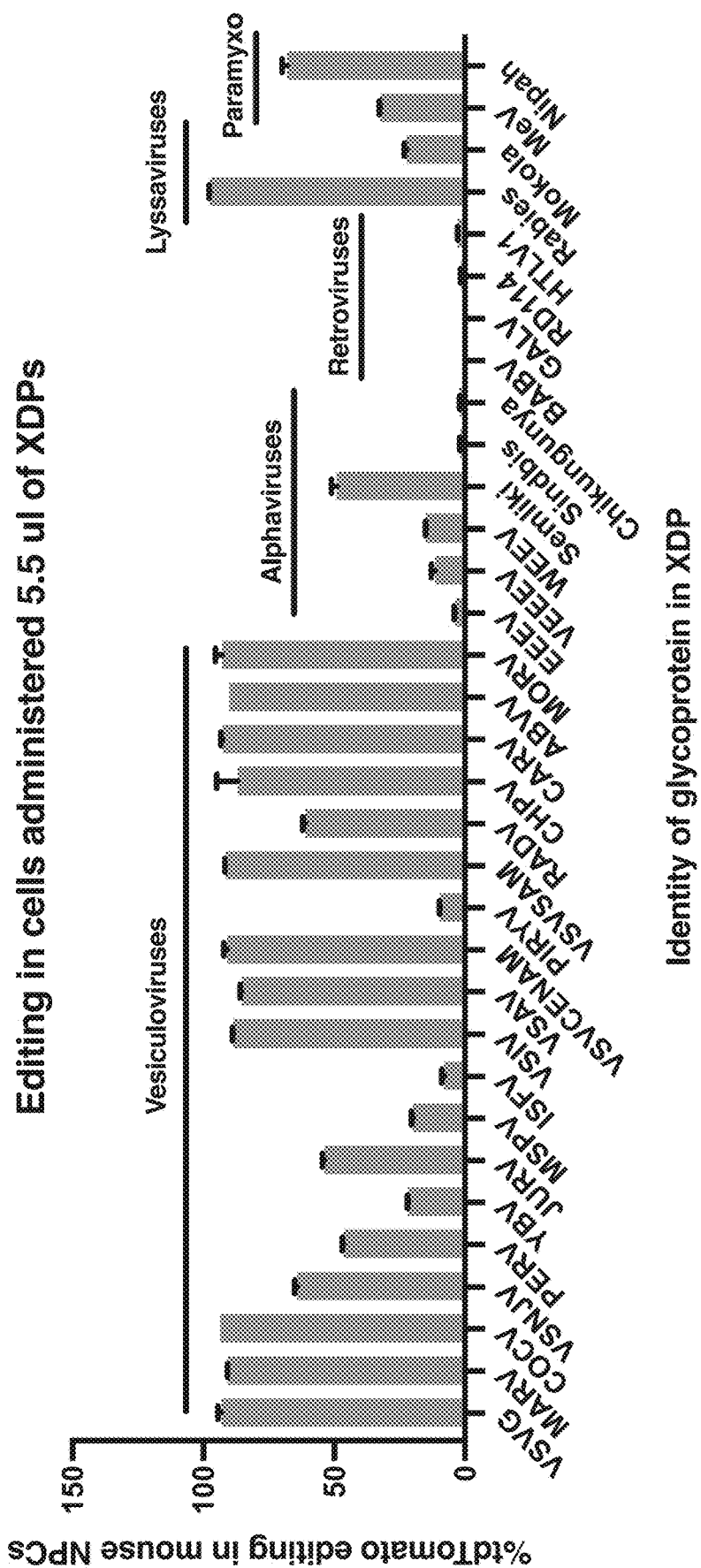

FIG. 125 is a bar graph of editing results with XDPs having various incorporated glycoproteins used to edit tdTomato in mouse NPCs, as described in Example 35.

Figure 126:
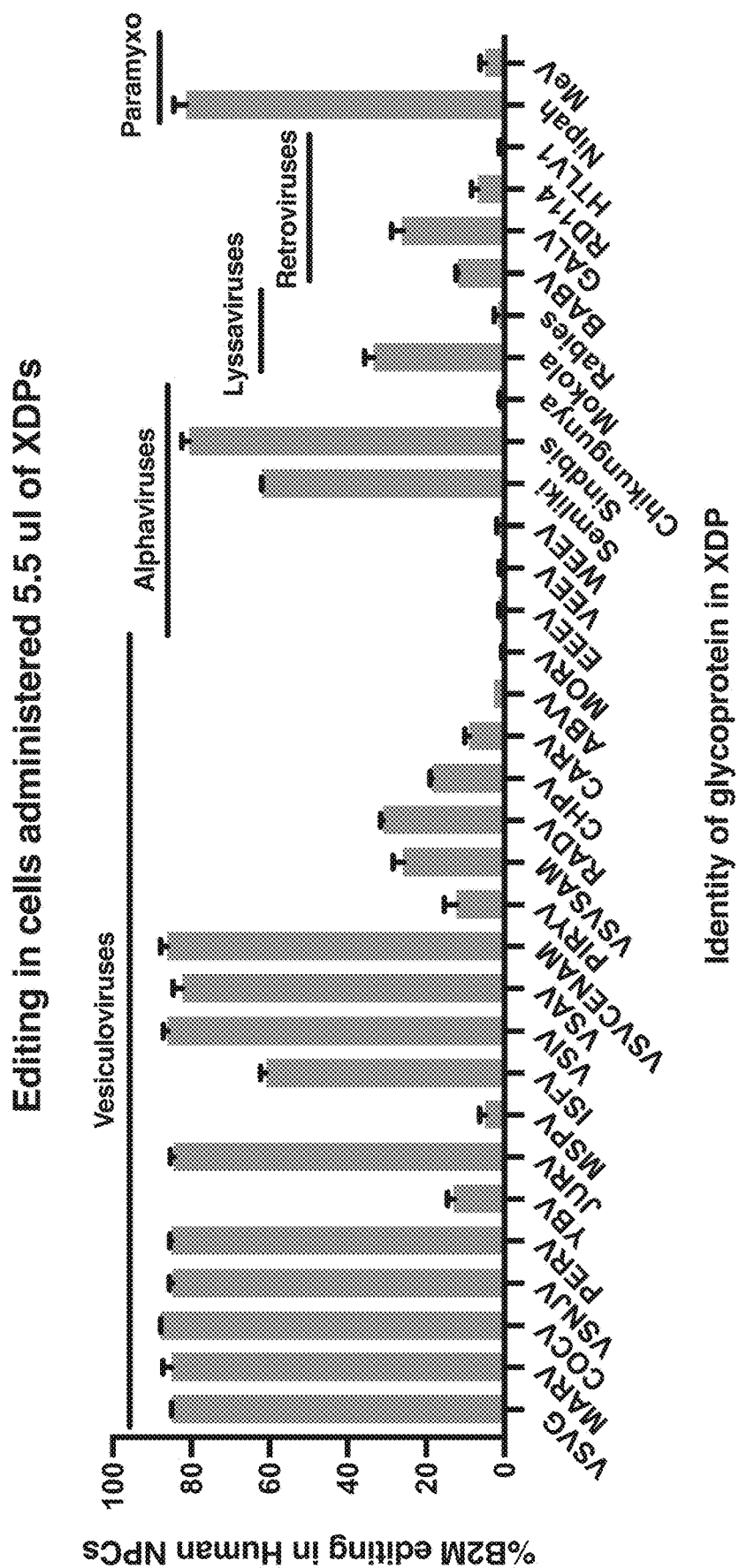

FIG. 126 is a bar graph of editing results with XDPs having various incorporated glycoproteins used to edit the B2M locus in human NPCs, as described in Example 35.

Figure 127:
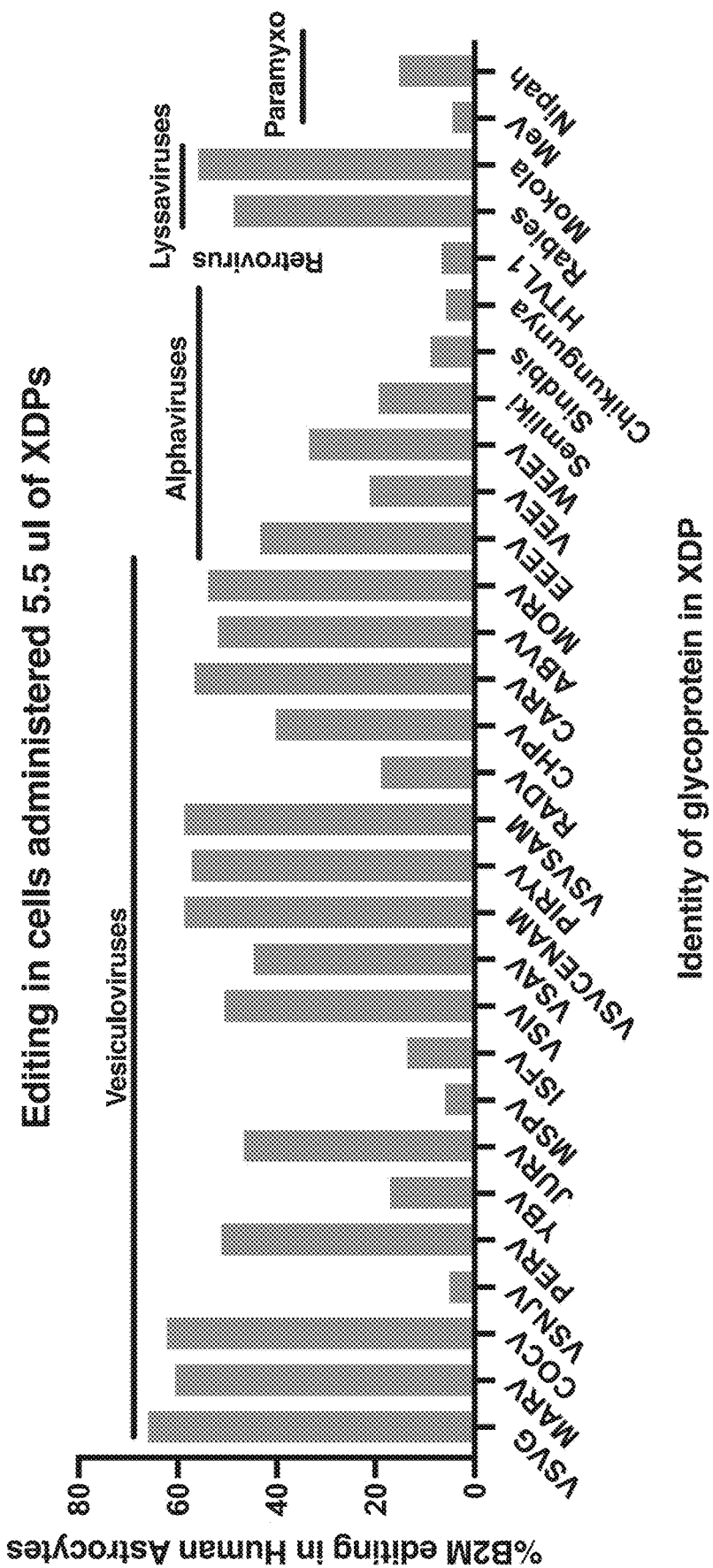

FIG. 127 is a bar graph of editing results with XDPs having various incorporated glycoproteins used to edit the B2M locus in human astrocytes, as described in Example 35.

Figure 128:
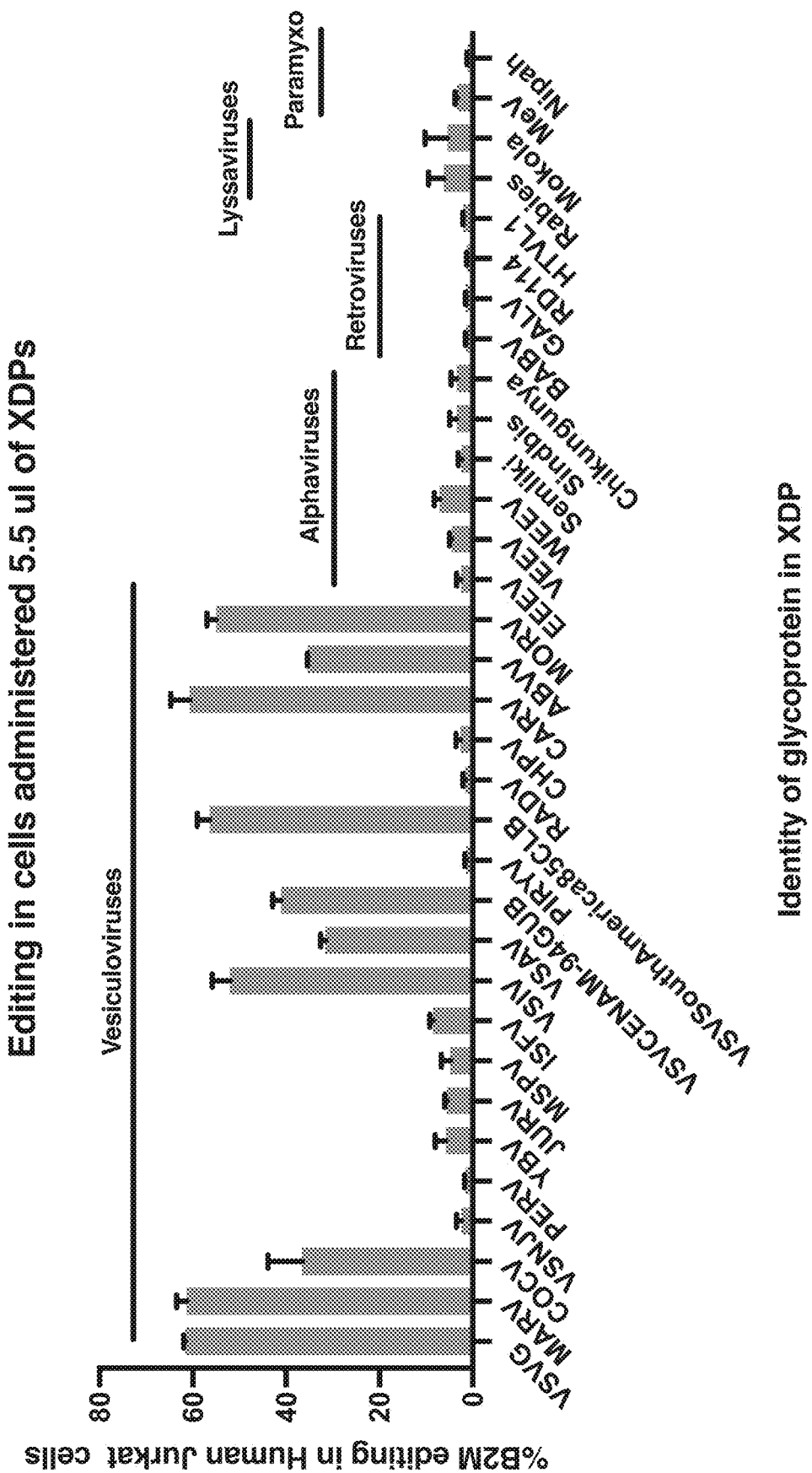

FIG. 128 is a bar graph of editing results with XDPs having various incorporated glycoproteins used to edit the B2M locus in human Jurkat cells, as described in Example 35.

Figure 129:
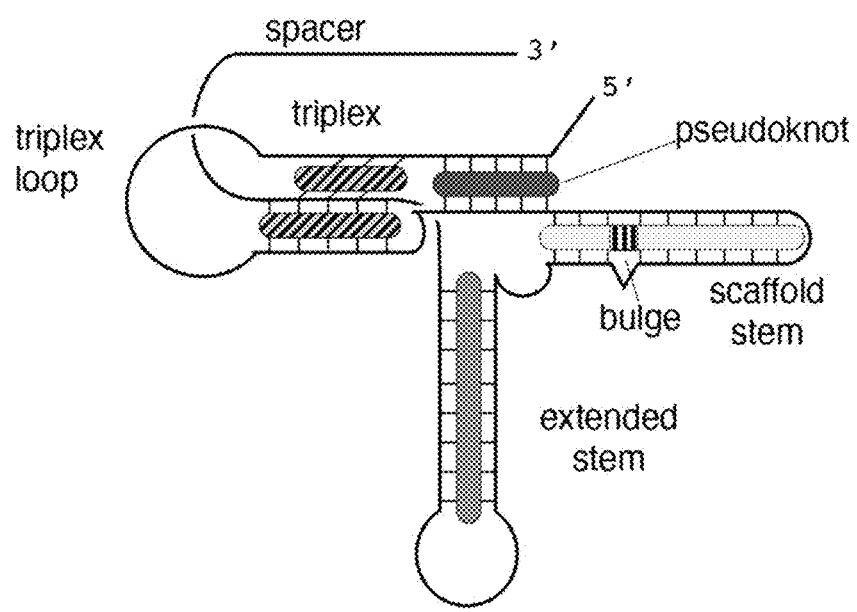

FIG. 129 is a schematic of the regions and domains of a guide RNA used to design a scaffold library, as described in Example 36.

Figure 130:
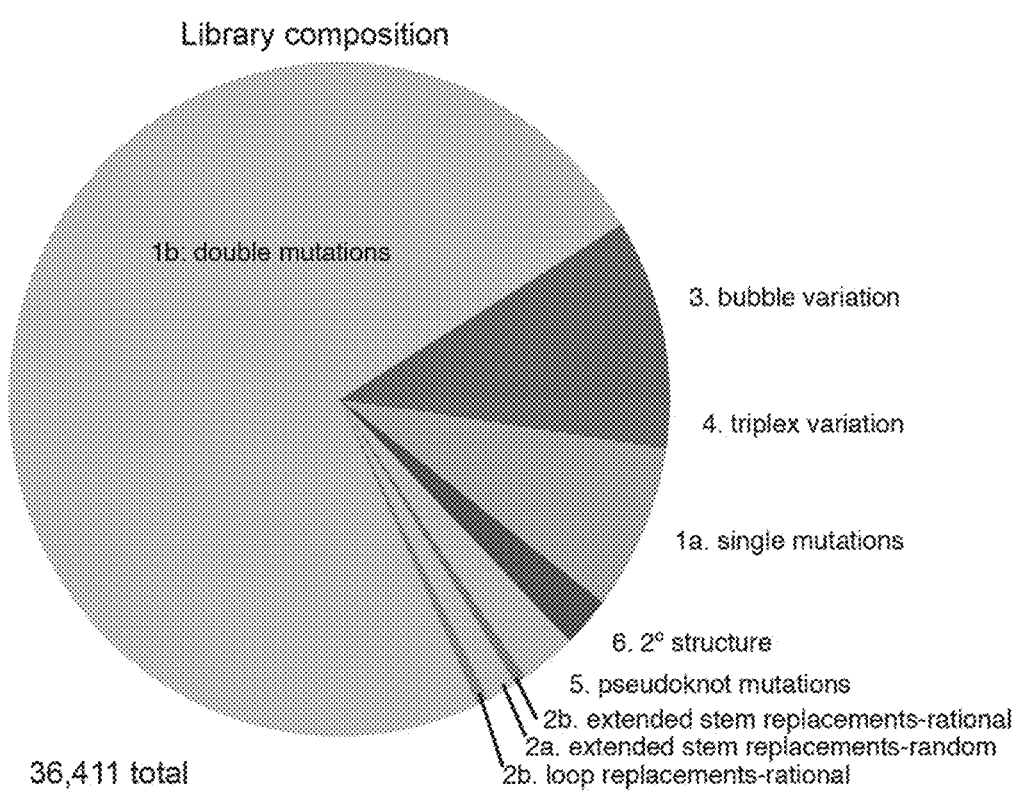

FIG. 130 is a pie chart of the relative distribution and design of the scaffold library with both unbiased (double and single mutations) and targeted mutations (towards the triplex, scaffold stem bubble, pseudoknot, and extended stem and loop) indicated, as described in Example 36.

Figure 131:
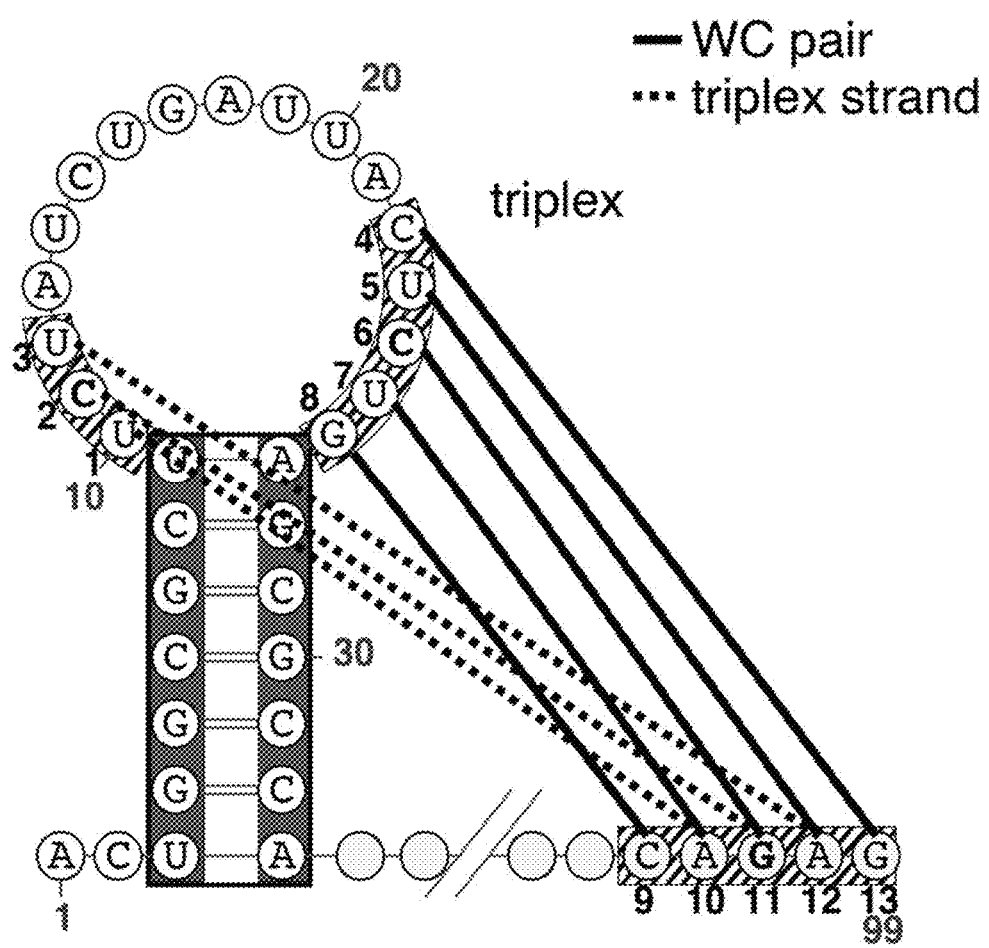

FIG. 131 is a schematic of the triplex mutagenesis designed to specifically incorporate alternate triplex-forming base pairs into the triplex, as described in Example 36. Solid lines indicate the Watson-Crick pair in the triplex; the third strand nucleotide is indicated as a dotted line representing the non-canonical interaction with the purine of the duplex. In the library, each of the 5 locations indicated was replaced with all possible triplex motifs (G:GC, T:AT, G:GC)=243 sequences. Sequence of (SEQ ID NO: 35172)
ACUGGCGCUUUUAUCUGAUUACUUUGAGAGCCAUCANNNAUCAAAG.

Figure 132:
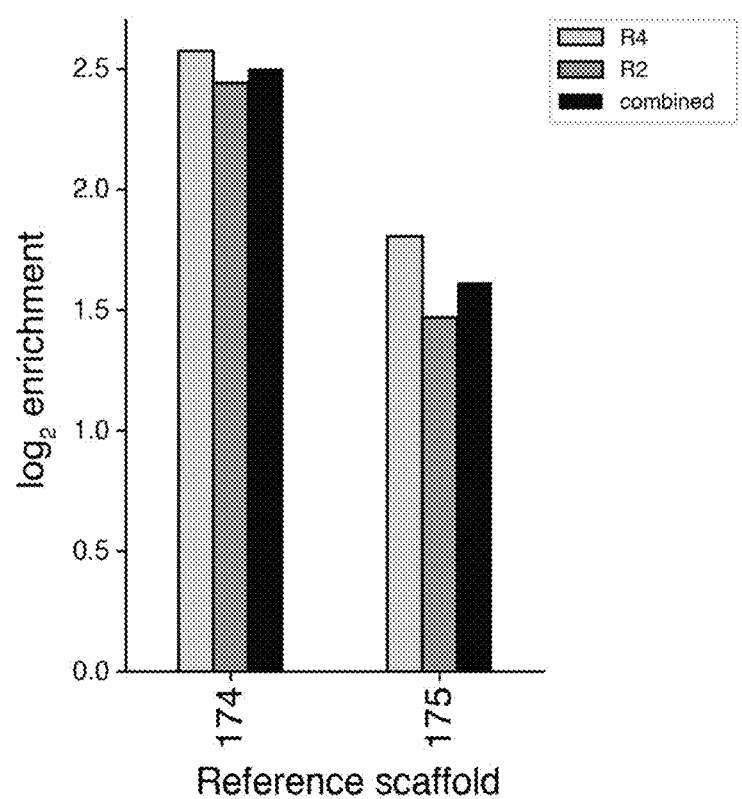

FIG. 132 is a bar chart with results of the enrichment values of reference guide scaffolds 174 and 175 in each screen, as described in Example 36.

Figure 133:
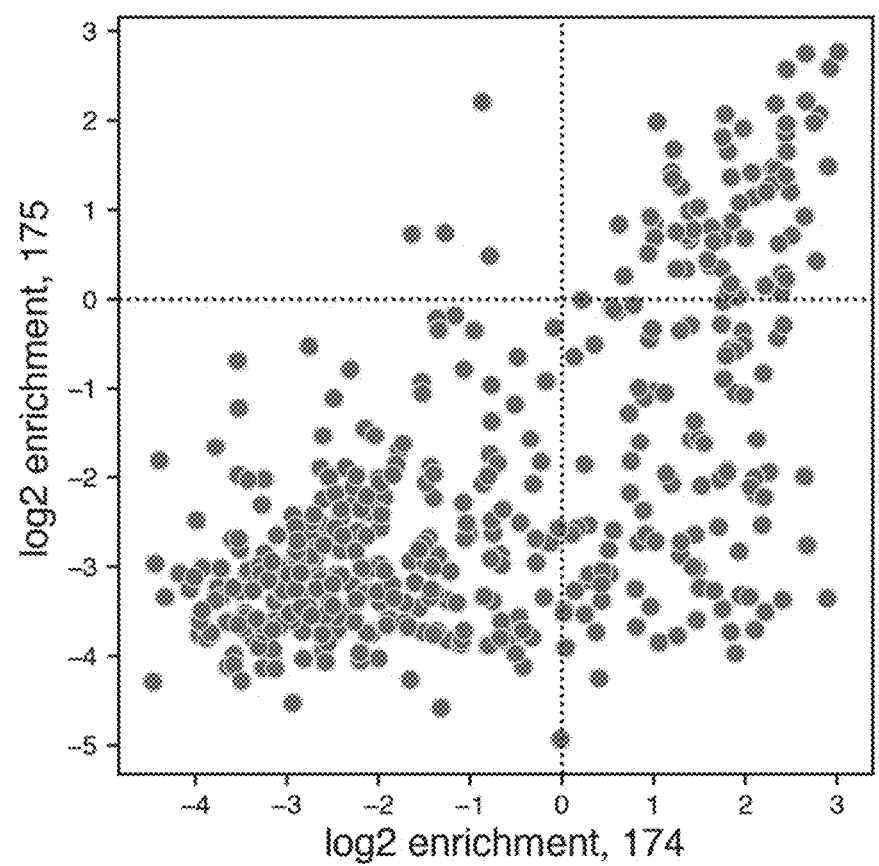

FIG. 133 is a scatterplot that compares the log$_2$ enrichment of single nucleotide mutations on reference guide scaffolds 174 and 175, as described in Example 36. Only those mutations to positions that were analogous between 174 and 175 are shown. Results suggest that, overall, guide scaffold 174 is more tolerant to changes than 175.

Figure 134:
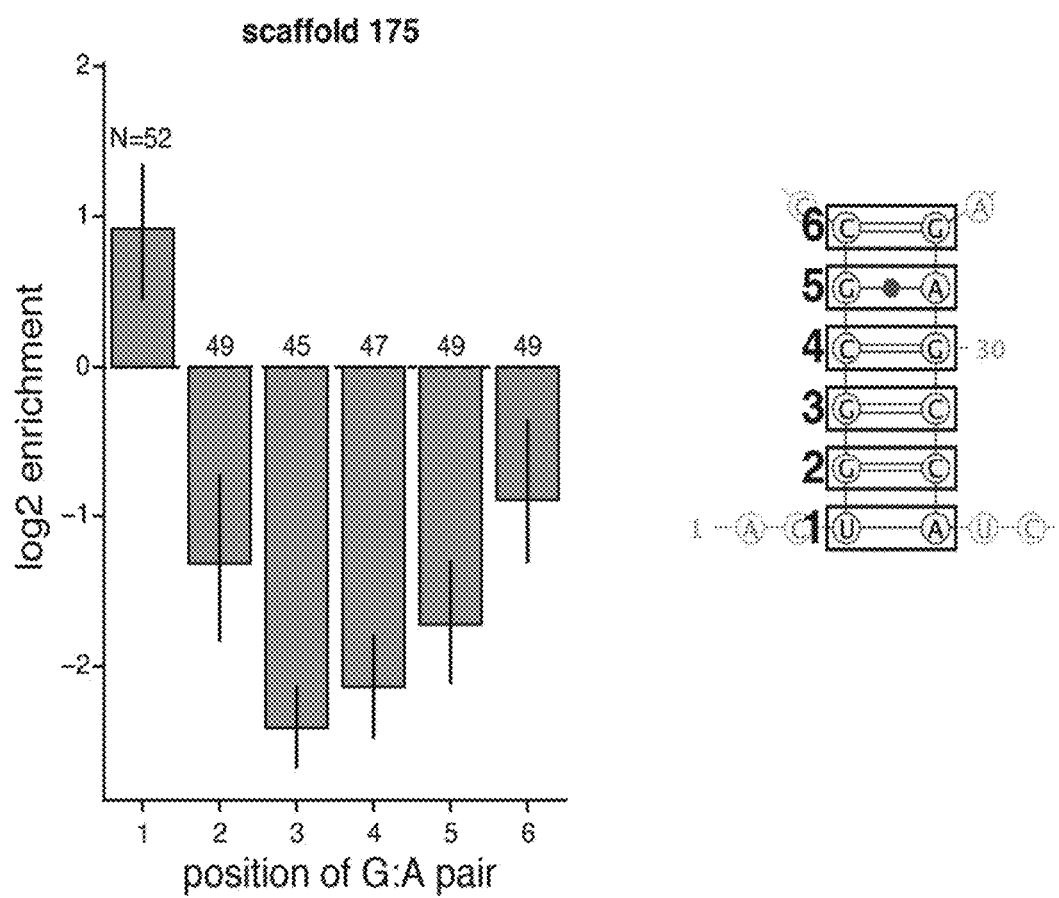

FIG. 134 is a bar chart showing the average (and 95% confidence interval) log$_2$ enrichment values for a set of scaffolds in which the pseudoknot pairs have been shuffled, such that each new pseudoknot has the same composition of base pairs, but in a different order within the stem, as described in Example 36. Each bar represents a set of scaffolds with the G:A (or A:G) pair location indicated (see diagram at right). 291 pseudoknot stems were tested; numbers above bars indicate the number of stems with the G:A (or A:G) pair at each position.

Figure 135:
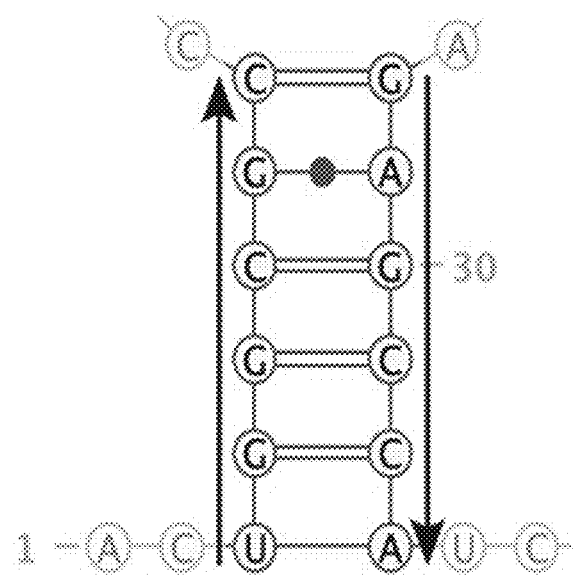

FIG. 135 is a schematic of the pseudoknot sequence of FIG. 129, given 5' to 3', with the two strand sequences separated by an underscore.

Figure 136:
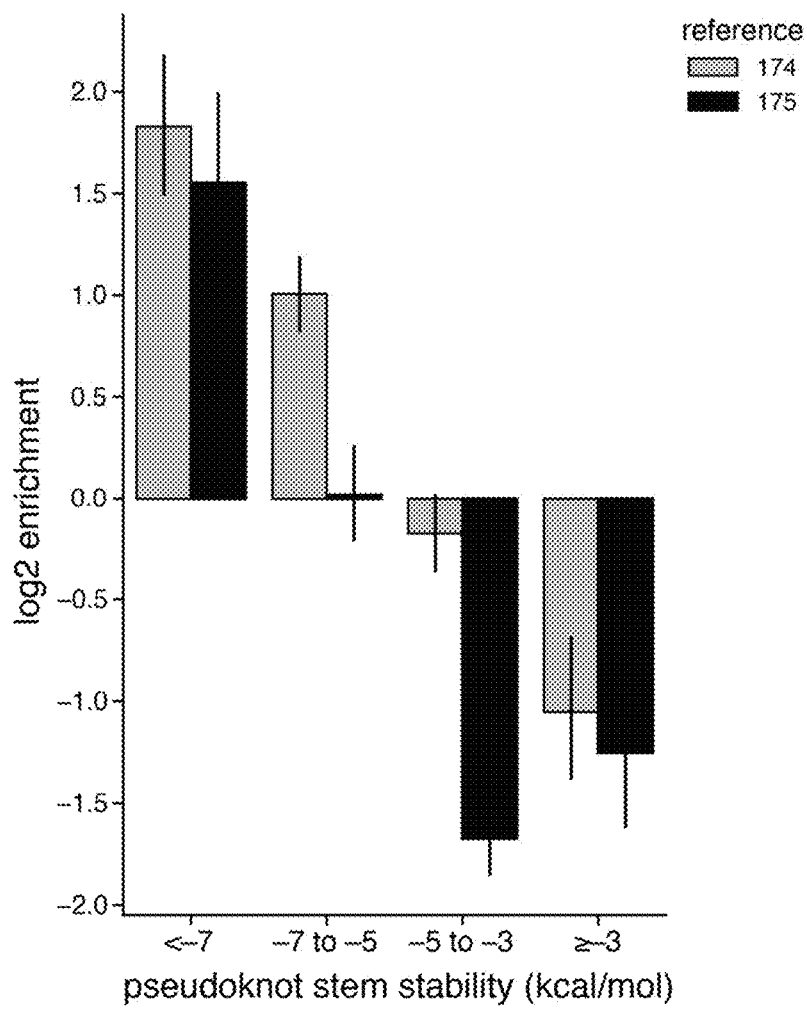

FIG. 136 is a bar chart showing the average (and 95% confidence interval) log$_2$ enrichment values for scaffolds, divided by the predicted secondary structure stability of the pseudoknot stem region, as described in Example 36. Scaffolds with very stable stems (e.g., $\Delta G < -7$ kcal/mol) had high enrichment values on average, whereas scaffolds with destabilized stems ($\Delta G \geq -5$ kcal/mol) had low enrichment values on average.

Figure 137:
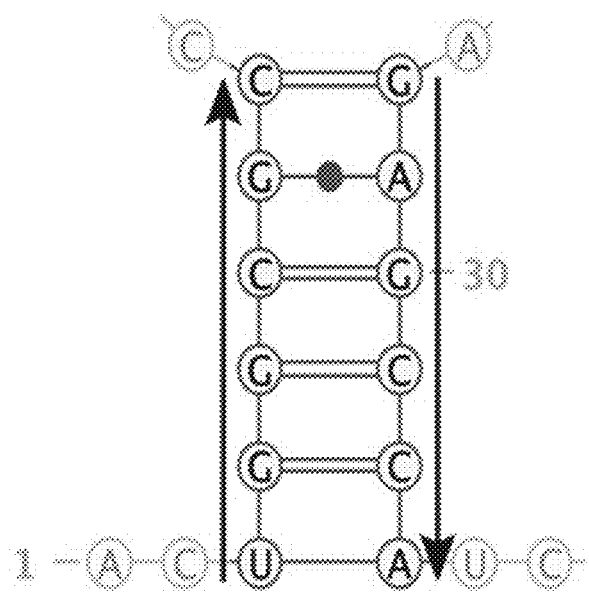

FIG. 137 portrays the secondary structure of the pseudoknot in scaffold 175, as described in Example 36. The pseudoknot sequence is given 5' to 3', on the right.

Figure 138:
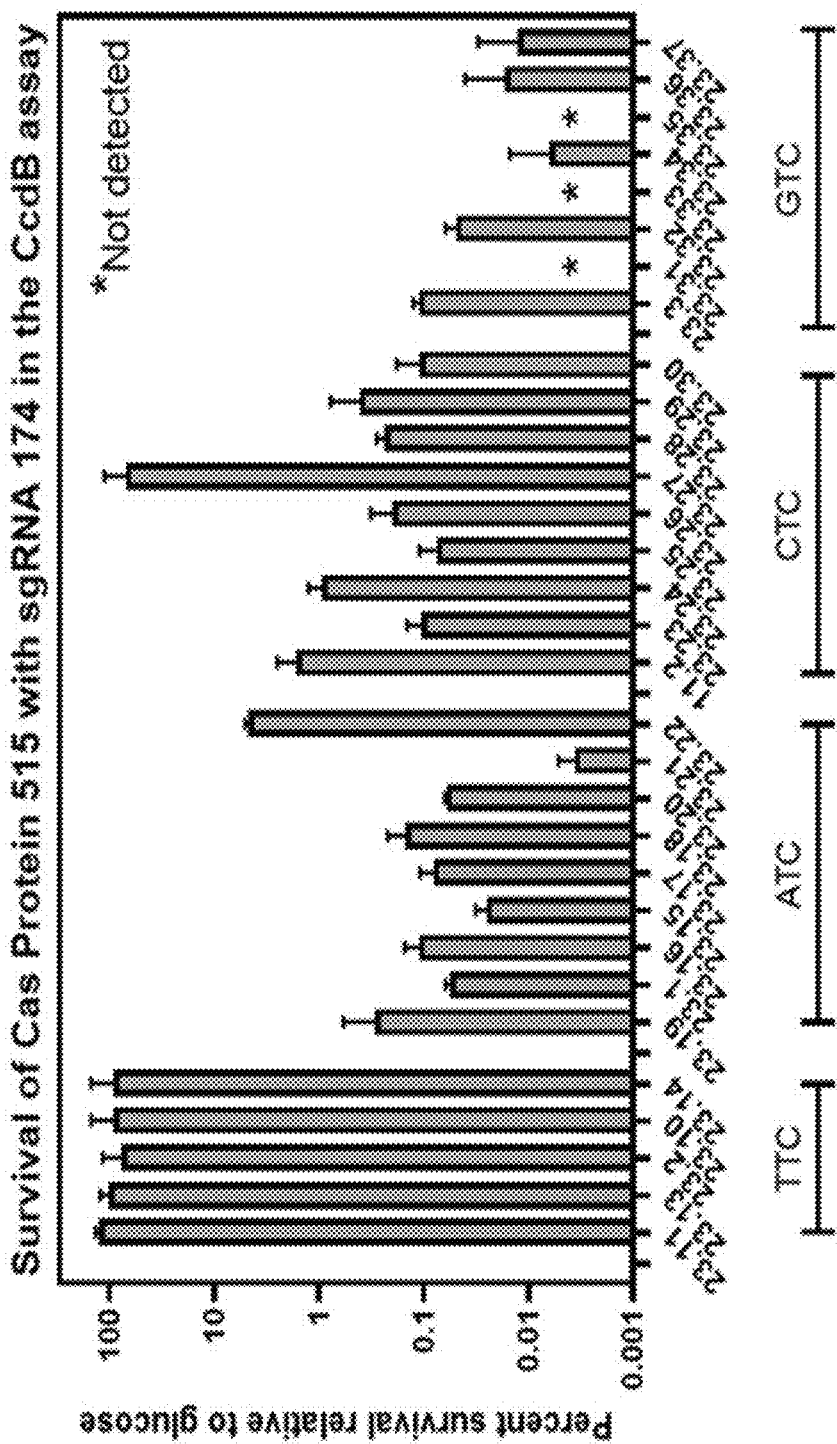

FIG. 138 is a graph of a survival assay to determine the selective stringency of the CcdB selection to different spacers when targeted by CasX protein 515 and Scaffold 174, as described in Example 37.

Figure 139:
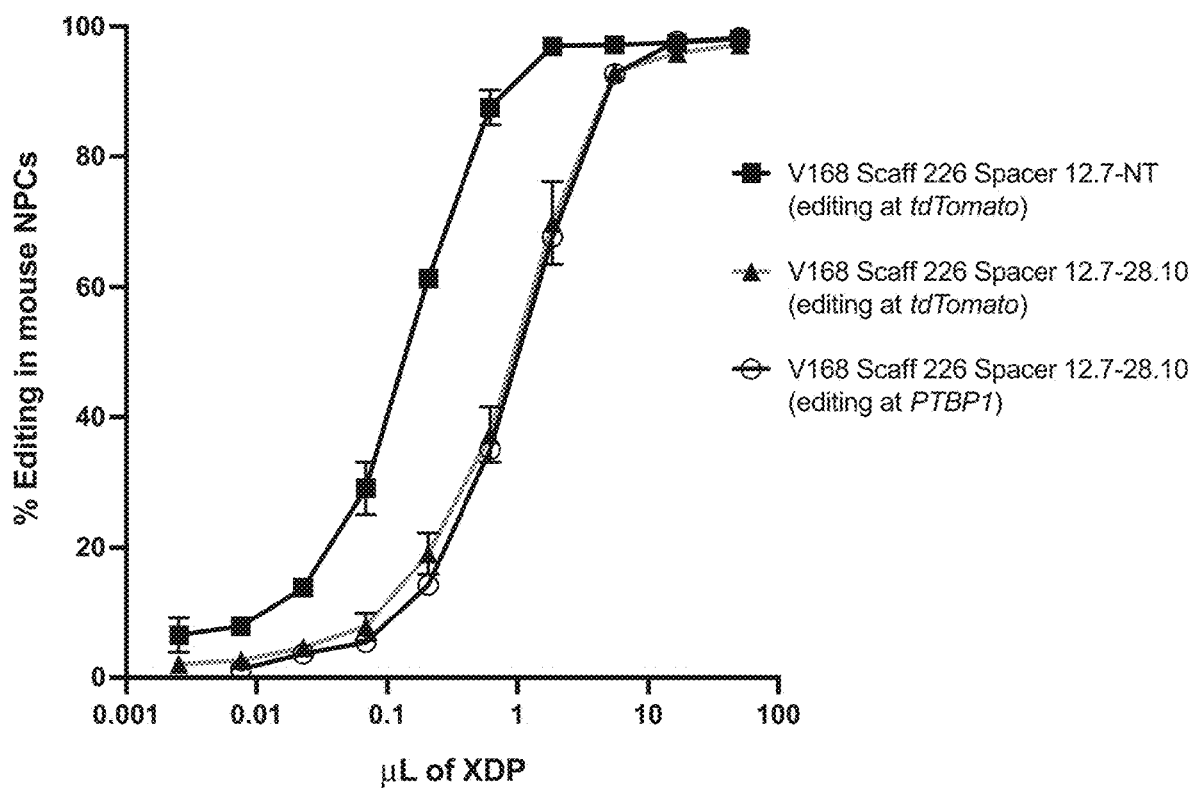

FIG. 139 is a plot illustrating percent editing at either the tdTomato locus, measured by tdTomato fluorescence, or the PTBP1 locus, measured as indel rate detected by next generation sequencing (NGS), in mouse NPCs, for V168 XDPs packaged with dual gRNAs containing the indicated spacers (tdTomato-targeting spacer 12.7, PTBP1-targeting spacer 28.10, or a non-targeting (NT) spacer), as described in Example 39.

Figure 140:
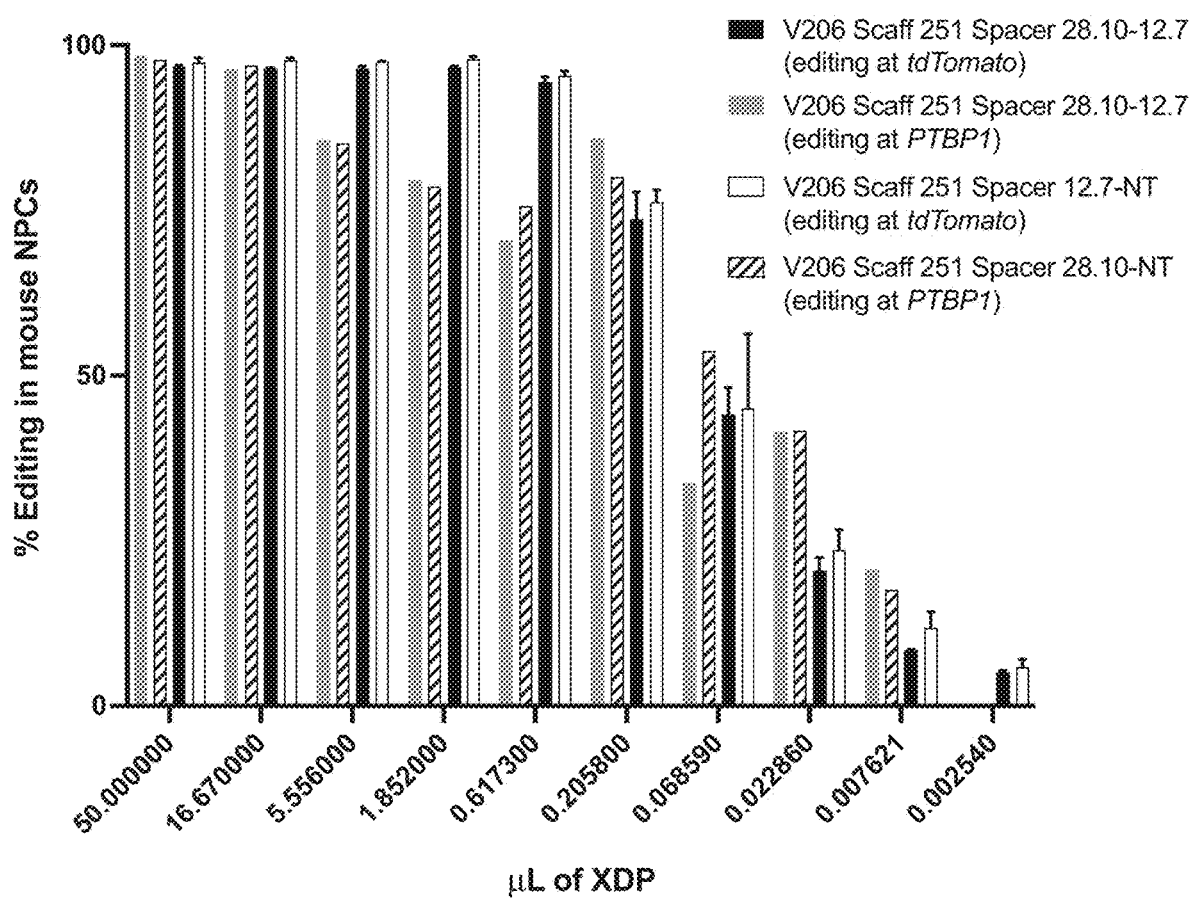

FIG. 140 is a plot illustrating percent editing at either the tdTomato locus, measured by tdTomato fluorescence, or the PTBP1 locus, measured as indel rate detected by NGS, in mouse NPCs, for V206 XDPs packaged with dual gRNAs containing the indicated spacers (tdTomato-targeting spacer 12.7, PTBP1-targeting spacer 28.10, or a non-targeting (NT) spacer), as described in Example 39.

DETAILED DESCRIPTION

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

Unless otherwise defined, all technical and scientific terms used herein have the same meaning as commonly understood by one of ordinary skill in the art to which this invention belongs. Although methods and materials similar or equivalent to those described herein can be used in the practice or testing of the present embodiments, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

The terms "polynucleotide" and "nucleic acid," used interchangeably herein, refer to a polymeric form of nucleotides of any length, either ribonucleotides or deoxyribonucleotides. Thus, terms "polynucleotide" and "nucleic acid" encompass single-stranded DNA; double-stranded DNA; multi-stranded DNA; single-stranded RNA; double-stranded RNA; multi-stranded RNA; genomic DNA; cDNA; DNA-RNA hybrids; and a polymer comprising purine and pyrimidine bases or other natural, chemically or biochemically modified, non-natural, or derivatized nucleotide bases.

"Hybridizable" or "complementary" are used interchangeably to mean that a nucleic acid (e.g., RNA, DNA) comprises a sequence of nucleotides that enables it to non-covalently bind, i.e., form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. It is understood that the sequence of a polynucleotide need not be 100% complementary to that of its target nucleic acid to be specifically hybridizable; it can have at least about 70%, at least about 80%, or at least about 90%, or at least about 95% sequence identity and still hybridize to the target nucleic acid. Moreover, a polynucleotide may hybridize over one or more segments such that intervening or adjacent segments are not involved in the hybridization event (e.g., a loop structure or hairpin structure, a 'bulge', 'bubble' and the like).

A "gene," for the purposes of the present disclosure, includes a DNA region encoding a gene product (e.g., a protein, RNA), as well as all DNA regions which regulate the production of the gene product, whether or not such regulatory sequences are adjacent to coding and/or transcribed sequences. Accordingly, a gene may include accessory element or promoter sequences including, but not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. Coding sequences encode a gene product upon transcription or transcription and translation; the coding sequences of the disclosure may comprise fragments and need not contain a full-length open reading frame. A gene can include both the strand that is transcribed as well as the complementary strand containing the anticodons.

The term "downstream" refers to a nucleotide sequence that is located 3' to a reference nucleotide sequence. In certain embodiments, downstream nucleotide sequences relate to sequences that follow the starting point of transcription. For example, the translation initiation codon of a gene is located downstream of the start site of transcription.

The term "upstream" refers to a nucleotide sequence that is located 5' to a reference nucleotide sequence. In certain embodiments, upstream nucleotide sequences relate to sequences that are located on the 5' side of a coding region or starting point of transcription. For example, most promoters are located upstream of the start site of transcription.

The term "accessory element" is used interchangeably herein with the term "accessory sequence," and is intended to include, inter alia, polyadenylation signals (poly(A) signal), enhancer elements, introns, posttranscriptional regulatory elements (PTREs), nuclear localization signals (NLS), deaminases, DNA glycosylase inhibitors, additional promoters, factors that stimulate CRISPR-mediated homology-directed repair (e.g. in cis or in trans), activators or repressors of transcription, self-cleaving sequences, and fusion domains, for example a fusion domain fused to a CRISPR protein. It will be understood that the choice of the appropriate accessory element or elements will depend on the encoded component to be expressed (e.g., protein or RNA) or whether the nucleic acid comprises multiple components that require different polymerases or are not intended to be expressed as a fusion protein.

The term "promoter" refers to a DNA sequence that contains a transcription start site and additional sequences to facilitate polymerase binding and transcription. Exemplary eukaryotic promoters include elements such as a TATA box, and/or B recognition element (BRE) and assists or promotes the transcription and expression of an associated transcribable polynucleotide sequence and/or gene (or transgene). A promoter can be synthetically produced or can be derived from a known or naturally occurring promoter sequence or another promoter sequence. A promoter can be proximal or distal to the gene to be transcribed. A promoter can also include a chimeric promoter comprising a combination of two or more heterologous sequences to confer certain properties. A promoter of the present disclosure can include variants of promoter sequences that are similar in composition, but not identical to, other promoter sequence(s) known or provided herein. A promoter can be classified according to criteria relating to the pattern of expression of an associated coding or transcribable sequence or gene operably linked to the promoter, such as constitutive, developmental, tissue-specific, inducible, etc. A promoter can also be classified according to its strength. As used in the context of a promoter, "strength" refers to the rate of transcription of the gene controlled by the promoter. A "strong" promoter means the rate of transcription is high, while a "weak" promoter means the rate of transcription is relatively low.

A promoter of the disclosure can be a Polymerase II (Pol II) promoter. Polymerase II transcribes all protein coding and many non-coding genes. A representative Pol II promoter includes a core promoter, which is a sequence of about 100 base pairs surrounding the transcription start site, and serves as a binding platform for the Pol II polymerase and associated general transcription factors. The promoter may contain one or more core promoter elements such as the TATA box, BRE, Initiator (INR), motif ten element (MTE), downstream core promoter element (DPE), downstream core element (DCE), although core promoters lacking these elements are known in the art.

A promoter of the disclosure can be a Polymerase III (Pol III) promoter. Pol III transcribes DNA to synthesize small ribosomal RNAs such as the 5S rRNA, tRNAs, and other small RNAs. Representative Pol III promoters use internal control sequences (sequences within the transcribed section of the gene) to support transcription, although upstream elements such as the TATA box are also sometimes used. All Pol III promoters are envisaged as within the scope of the instant disclosure.

The term "enhancer" refers to regulatory DNA sequences that, when bound by specific proteins called transcription factors, regulate the expression of an associated gene. Enhancers may be located in the intron of the gene, or 5' or 3' of the coding sequence of the gene. Enhancers may be proximal to the gene (i.e., within a few tens or hundreds of base pairs (bp) of the promoter), or may be located distal to the gene (i.e., thousands of bp, hundreds of thousands of bp, or even millions of bp away from the promoter). A single gene may be regulated by more than one enhancer, all of which are envisaged as within the scope of the instant disclosure.

As used herein, a "post-transcriptional regulatory element (PTRE)," such as a hepatitis PTRE, refers to a DNA sequence that, when transcribed, creates a tertiary structure capable of exhibiting post-transcriptional activity to enhance or promote expression of an associated gene operably linked thereto.

"Recombinant," as used herein, means that a particular nucleic acid (DNA or RNA) is the product of various combinations of cloning, restriction, and/or ligation steps resulting in a construct having a structural coding or non-coding sequence distinguishable from endogenous nucleic acids found in natural systems. Generally, DNA sequences encoding the structural coding sequence can be assembled from cDNA fragments and short oligonucleotide linkers, or from a series of synthetic oligonucleotides, to provide a synthetic nucleic acid which is capable of being expressed from a recombinant transcriptional unit contained in a cell or in a cell-free transcription and translation system. Such sequences can be provided in the form of an open reading frame uninterrupted by internal non-translated sequences, or introns, which are typically present in eukaryotic genes. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions, and may indeed act to modulate production of a desired product by various mechanisms (see "enhancers" and "promoters", above).

The term "recombinant polynucleotide" or "recombinant nucleic acid" refers to one which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such is usually done to replace a codon with a redundant codon encoding the same or a conservative amino acid, while typically introducing or removing a sequence recognition site. Alternatively, it is performed to join together nucleic acid segments of desired functions to generate a desired combination of functions. This artificial combination is often accomplished by either chemical synthesis means, or by the artificial manipulation of isolated segments of nucleic acids, e.g., by genetic engineering techniques.

Similarly, the term "recombinant polypeptide" or "recombinant protein" refers to a polypeptide or protein which is not naturally occurring, e.g., is made by the artificial combination of two otherwise separated segments of amino sequence through human intervention. Thus, e.g., a protein that comprises a heterologous amino acid sequence is recombinant.

The term "Rev response element" or "RRE" refers to a cis-acting post-transcriptional regulatory element that facilitates, in the context of the present disclosure, the transport of a gRNA from the nucleus, across the nuclear membrane, to the cytoplasm of a cell by complexing with factors such as HIV-1 Rev.

As used herein, the term "contacting" means establishing a physical connection between two or more entities. For example, contacting a target nucleic acid with a guide nucleic acid means that the target nucleic acid and the guide nucleic acid are made to share a physical connection; e.g., can hybridize if the sequences share sequence similarity.

"Dissociation constant", or "$K_d$", are used interchangeably and mean the affinity between a ligand "L" and a protein "P"; i.e., how tightly a ligand binds to a particular protein. It can be calculated using the formula $K_d=[L][P]/[LP]$, where [P], [L] and [LP] represent molar concentrations of the protein, ligand and complex, respectively.

The disclosure provides compositions and methods useful for modifying a target nucleic acid. As used herein "modifying" and "modification" are used interchangeably to include cleaving, nicking, editing, deleting, knocking in, knocking out, and the like.

The term "knock-out" refers to the elimination of a gene or the expression of a gene. For example, a gene can be knocked out by either a deletion or an addition of a nucleotide sequence that leads to a disruption of the reading frame. As another example, a gene may be knocked out by replacing a part of the gene with an irrelevant sequence. The term "knock-down" as used herein refers to reduction in the expression of a gene or its gene product(s). As a result of a gene knock-down, the protein activity or function may be attenuated or the protein levels may be reduced or eliminated.

As used herein, "homology-directed repair" (HDR) refers to the form of DNA repair that takes place during repair of double-strand breaks in cells. This process requires nucleotide sequence homology, and uses a donor template to repair or knock-out a target DNA, and leads to the transfer of genetic information from the donor to the target. Homology-directed repair can result in an alteration of the sequence of the target sequence by insertion, deletion, or mutation if the donor template differs from the target DNA sequence and part or all of the sequence of the donor template is incorporated into the target DNA.

As used herein, "non-homologous end joining" (NHEJ) refers to the repair of double-strand breaks in DNA by direct ligation of the break ends to one another without the need for a homologous template (in contrast to homology-directed repair, which requires a homologous sequence to guide repair). NHEJ often results in the loss (deletion) of nucleotide sequence near the site of the double-strand break.

As used herein "micro-homology mediated end joining" (MMEJ) refers to a mutagenic DSB repair mechanism, which always associates with deletions flanking the break sites without the need for a homologous template (in contrast to homology-directed repair, which requires a homologous sequence to guide repair). MMEJ often results in the loss (deletion) of nucleotide sequence near the site of the double-strand break. A polynucleotide or polypeptide has a certain percent "sequence similarity" or "sequence identity" to another polynucleotide or polypeptide, meaning that, when aligned, that percentage of bases or amino acids are the same, and in the same relative position, when comparing the two sequences. Sequence similarity (sometimes referred to as percent similarity, percent identity, or homology) can be determined in a number of different manners. To determine sequence similarity, sequences can be aligned using the methods and computer programs that are known in the art, including BLAST, available over the world wide web at ncbi.nlm.nih.gov/BLAST. Percent complementarity between particular stretches of nucleic acid sequences within nucleic acids can be determined using any convenient method. Example methods include BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), e.g., using default settings, which uses the algorithm of Smith and Waterman (Adv. Appl. Math., 1981, 2, 482-489).

The terms "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones. The term includes fusion proteins, including, but not limited to, fusion proteins with a heterologous amino acid sequence.

A "vector" or "expression vector" is a replicon, such as plasmid, phage, virus, or cosmid, to which another DNA segment, i.e., an "insert", may be attached so as to bring about the replication or expression of the attached segment in a cell.

The term "naturally-occurring" or "unmodified" or "wild type" as used herein as applied to a nucleic acid, a polypeptide, a cell, or an organism, refers to a nucleic acid, polypeptide, cell, or organism that is found in nature.

As used herein, a "mutation" refers to an insertion, deletion, substitution, duplication, or inversion of one or more amino acids or nucleotides as compared to a wild-type or reference amino acid sequence or to a wild-type or reference nucleotide sequence.

As used herein the term "isolated" is meant to describe a polynucleotide, a polypeptide, or a cell that is in an environment different from that in which the polynucleotide, the polypeptide, or the cell naturally occurs. An isolated genetically modified host cell may be present in a mixed population of genetically modified host cells.

A "host cell," as used herein, denotes a eukaryotic cell, a prokaryotic cell, or a cell from a multicellular organism (e.g., a cell line) cultured as a unicellular entity, which eukaryotic or prokaryotic cells are used as recipients for a nucleic acid (e.g., an expression vector), and include the progeny of the original cell which has been genetically modified by the nucleic acid. It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host cell into which has been introduced a heterologous nucleic acid, e.g., an expression vector.

The term "tropism" as used herein refers to preferential entry of the XDP into certain cell, organ, or tissue type(s) and/or preferential interaction with the cell surface that facilitates entry into certain cell, organ, or tissue types, optionally and preferably followed by expression (e.g., transcription and, optionally, translation) of sequences carried by the XDP into the cell.

The terms "pseudotype" or "pseudotyping" as used herein, refers to viral envelope proteins that have been substituted with those of another virus possessing preferable characteristics. For example, HIV can be pseudotyped with vesicular stomatitis virus G-protein (VSV-G) envelope proteins (amongst others, described herein, below), which allows HIV to infect a wider range of cells because HIV envelope proteins target the virus mainly to CD4+ presenting cells.

The term "tropism factor" as used herein refers to components integrated into the surface of an XDP that provides tropism for a certain cell, organ, or tissue type. Non-limiting examples of tropism factors include glycoproteins, antibody fragments (e.g., scFv, nanobodies, linear antibodies, etc.), receptors and ligands to target cell receptors or cell markers.

A "target cell marker" refers to a molecule expressed by a target cell including but not limited to cell-surface receptors, cytokine receptors, antigens, tumor-associated antigens, glycoproteins, oligonucleotides, enzymatic substrates, antigenic determinants, or binding sites that may be present in the on the surface of a target tissue or cell that may serve as ligands for a tropism factor.

An "antibody fragment" refers to a molecule other than an intact antibody that comprises a portion of an intact antibody and that binds the antigen to which the intact antibody binds. Examples of antibody fragments include but are not limited to Fv, Fab, Fab', Fab'-SH, F(ab')2, diabodies, single chain diabodies, linear antibodies, a single domain antibody, a single domain camelid antibody, single-chain variable fragment (scFv) antibody molecules, and multispecific antibodies formed from antibody fragments.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide-containing side chains consists of asparagine and glutamine; a group of amino acids having aromatic side chains consists of phenylalanine, tyrosine, and tryptophan; a group of amino acids having basic side chains consists of lysine, arginine, and histidine; and a group of amino acids having sulfur-containing side chains consists of cysteine and methionine. Exemplary conservative amino acid substitution groups are: valine-leucine-isoleucine, phenylalanine-tyrosine, lysine-arginine, alanine-valine, and asparagine-glutamine.

As used herein, "treatment" or "treating," are used interchangeably herein and refer to an approach for obtaining beneficial or desired results, including but not limited to a therapeutic benefit and/or a prophylactic benefit. By therapeutic benefit is meant eradication or amelioration of the underlying disorder or disease being treated. A therapeutic benefit can also be achieved with the eradication or amelioration of one or more of the symptoms or an improvement in one or more clinical parameters associated with the underlying disease such that an improvement is observed in the subject, notwithstanding that the subject may still be afflicted with the underlying disorder.

The terms "therapeutically effective amount" and "therapeutically effective dose", as used herein, refer to an amount of a drug or a biologic, alone or as a part of a composition, that is capable of having any detectable, beneficial effect on any symptom, aspect, measured parameter or characteristics of a disease state or condition when administered in one or repeated doses to a subject such as a human or an experimental animal. Such effect need not be absolute to be beneficial.

As used herein, "administering" means a method of giving a dosage of a compound (e.g., a composition of the disclosure) or a composition (e.g., a pharmaceutical composition) to a subject.

A "subject" is a mammal. Mammals include, but are not limited to, domesticated animals, non-human primates, humans, dogs, rabbits, mice, rats and other rodents.

All publications, patents, and patent applications mentioned in this specification are herein incorporated by reference to the same extent as if each individual publication, patent, or patent application was specifically and individually indicated to be incorporated by reference.

I. GENERAL METHODS

The practice of the present invention employs, unless otherwise indicated, conventional techniques of immunology, biochemistry, chemistry, molecular biology, microbiology, cell biology, genomics and recombinant DNA, which can be found in such standard textbooks as Molecular Cloning: A Laboratory Manual, 3rd Ed. (Sambrook et al., Cold Spring Harbor Laboratory Press 2001); Short Protocols in Molecular Biology, 4th Ed. (Ausubel et al. eds., John Wiley & Sons 1999); Protein Methods (Bollag et al., John Wiley & Sons 1996); Nonviral Vectors for Gene Therapy (Wagner et al. eds., Academic Press 1999); Viral Vectors (Kaplift & Loewy eds., Academic Press 1995); Immunology Methods Manual (I. Lefkovits ed., Academic Press 1997); and Cell and Tissue Culture: Laboratory Procedures in Biotechnology (Doyle & Griffiths, John Wiley & Sons 1998), the disclosures of which are incorporated herein by reference.

Where a range of values is provided, it is understood that endpoints are included and that each intervening value, to the tenth of the unit of the lower limit unless the context clearly dictates otherwise, between the upper and lower limit of that range and any other stated or intervening value in that stated range, is encompassed. The upper and lower limits of these smaller ranges may independently be included in the smaller ranges, and are also encompassed, subject to any specifically excluded limit in the stated range. Where the stated range includes one or both of the limits, ranges excluding either or both of those included limits are also included.

Unless defined otherwise, all technical and scientific terms used herein have the same meaning as commonly understood by one of ordinary skill in the art to which this invention belongs. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise.

It will be appreciated that certain features of the disclosure, which are, for clarity, described in the context of separate embodiments, may also be provided in combination in a single embodiment. In other cases, various features of the disclosure, which are, for brevity, described in the context of a single embodiment, may also be provided separately or in any suitable sub-combination. It is intended that all combinations of the embodiments pertaining to the

II. PARTICLE DELIVERY SYSTEMS FOR USE IN TARGETING CELLS

In a first aspect, the present disclosure relates to particle delivery systems (XDP) designed to self-assemble particles comprising therapeutic payloads wherein the particles are designed for selective delivery to targeted cells, organs and tissues. As used herein, the term "XDP" refers to a non-replicating, self-assembling, non-naturally occurring multi-component structure composed of one or more viral proteins, polyproteins, virally-derived peptides or polypeptides, such as, but not limited to, capsid, coat, and shell, as well as tropism factors such as envelope glycoproteins derived from viruses, antibody fragments, receptors or ligand utilized for tropism to direct the XDP to target cells, organ, or tissues, with a lipid layer (derived from the host packaging cell), wherein the XDP are capable of self-assembly in a host cell and encapsidating or encompassing a therapeutic payload. The XDP of the present disclosure can be created in multiple forms and configurations. The XDP of present disclosure can be utilized to specifically and selectively deliver therapeutic payloads to target cells, organs, or tissues. The XDP of the disclosure have utility in a variety of methods, including, but not limited to, use in delivering a therapeutic payload in a selective fashion to a target cell, organ or tissue for the treatment of a disease.

In some embodiments, the present disclosure provides XDP systems comprising nucleic acid sequences encoding the components of the XDP, the therapeutic payload and tropism factor(s) that, that, when introduced into an appropriate eukaryotic host packaging cell, result in the expression of the individual XDP structural components, processing proteins, therapeutic payloads, and tropism factors that self-assemble into XDP particles that encapsidate the therapeutic payload, and incorporate the tropism factor within the membrane envelope upon budding from the packaging host cell. Upon release from the packaging host cell, the XDP particles can be collected and purified for the methods and uses described herein.

In some embodiments, the therapeutic payloads packaged within the XDP comprise therapeutic proteins, described more fully below. In other embodiments, the therapeutic payloads packaged within XDP comprise therapeutic nucleic acids or nucleic acids that encode therapeutic proteins. In other embodiments, the XDP comprise therapeutic proteins and nucleic acids. In some cases, the therapeutic payloads include gene editing systems such as CRISPR nucleases and guide RNA, zinc finger proteins or Transcription activator-like effector nucleases (TALENs) useful for the editing of nucleic acids in target cells. In some embodiments, the therapeutic payloads include Class 2 CRISPR-Cas systems. Class 2 systems are distinguished from Class 1 systems in that they have a single multi-domain effector protein and are further divided into a Type II, Type V, or Type VI system, described in Makarova, et al. Evolutionary classification of CRISPR-Cas systems: a burst of class 2 and derived variants. Nature Rev. Microbiol. 18:67 (2020), incorporated herein by reference. In some embodiments, the nucleases include Class 2, Type II CRISPR/Cas nucleases such as Cas9. In other cases, the nucleases include Class 2, Type V CRISPR/Cas nucleases such as a Cas12a (Cpf1), Cas12b (C2c1), Cas12c (C2c3), Cas12d (CasY), Cas12e (CasX), Cas12f, Cas12g, Cas12h, Cas12i, Cas12j, Cas12k, Cas12l, Cas14, and/or CasΦ. The CRISPR-Cas nuclease and guide RNA (gRNA) system payloads can do one or more of the following: (i) modify (e.g., edit) a target ssDNA, dsDNA or RNA (e.g., cleave, nick, or methylate); (ii) modulate transcription of the target nucleic acid; (iii) bind the target nucleic acid (e.g., for purposes of isolation, blocking transcription, labeling, or imaging, etc.); or (v) modify a polypeptide associated with a target nucleic acid. In a particular embodiment, the present disclosure provides XDP compositions, and methods to make the XDP compositions, which are designed to more effectively package ribonucleic acid particles (RNP) comprising CasX and guide RNA systems (CasX:gRNA system) useful for the editing of nucleic acids in target cells, described more fully, below. Accordingly, the present disclosure provides XDP compositions, nucleic acids that encode the components of the XDP (both structural as well as gene-editing components), as well as methods of making and using the XDP. The nucleic acids, the components of the compositions, and the methods of making and using them, are described herein, below.

a. XDP Retroviral Components

XDP can be created in multiple forms and configurations. The structural components of the XDP of the present disclosure are derived from members of the Retroviridae family of viruses, described more fully, below. The major structural component of retroviruses is the polyprotein Gag, which also typically contains protease cleavage sites that, upon action by the viral protease, processes the Gag polyprotein into subcomponents that, in the case of the replication of the source virus, then self-assemble in the host cell to make the core inner shell of the virus. The expression of Gag alone is sufficient to mediate the assembly and release of virus-like particles (VLPs) from host cells. Gag proteins from all retroviruses contain an N-terminal membrane-binding matrix (MA) domain, a capsid (CA) domain (with two subdomains), and a nucleocapsid (NC) domain that are structurally similar across retroviral genera but differ greatly in sequence. Outside these core domains, Gag proteins vary among retroviruses, and other linkers and domains may be present (Shur, F., et al. The Structure of Immature Virus-Like Rous Sarcoma Virus Gag Particles Reveals a Structural Role for the p10 Domain in Assembly. J Virol. 89(20):10294 (2015)). The assembly pathway of Gag into immature particles in the host cell is mediated by interactions between MA (which is responsible for targeting Gag polyprotein to the plasma membrane), between NC and RNA, and between CA domains (which, in the context of the present disclosure, assemble into the XDP capsid). For most retrovirus genera, assembly takes place on the plasma membrane, but for Betaretroviruses the particles are assembled in the cytoplasm and then transported to the plasma membrane. In the context of the retroviruses, cleavage of Gag by the viral protease (PR) gives rise to separate MA, CA, and NC proteins, inducing a rearrangement of the internal viral structure, with CA forming the shell of the mature viral core. Full proteolytic cleavage of Gag into its individual domains is necessary for virus infectivity for the native viruses. However, it has been discovered that for self-assembly of XDP within a host packaging cell, the XDP does not require, in some configuration embodiments, cleavage of Gag; hence the omission of a protease and cleavage sites is possible in some embodiments, described more fully, below, including those of the Examples.

The Retroviridae family of viruses have different subfamilies, including Orthoretrovirinae, Spumaretrovirinae, and unclassified Retroviridae. Many retroviruses cause serious diseases in humans, other mammals, and birds. Human retroviruses include Human Immunodeficiency Virus 1 (HIV-1) and HIV-2, the cause of the disease AIDS, and human T-lymphotropic virus (HTLV) also cause disease in humans. The subfamily Orthoretrovirinae include the genera Alpharetrovirus, Betaretrovirus, Deltaretrovirus, Epsilonretrovirus, Gammaretrovirus, and Lentivirus. Members of Alpharetrovirus, including Avian leukosis virus and Rous sarcoma virus, can cause sarcomas, tumors, and anemia of wild and domestic birds. Examples of Betaretrovirus include mouse mammary tumor virus, Mason-Pfizer monkey virus, and enzootic nasal tumor virus. Examples of Deltaretrovirus include the bovine leukemia virus and the human T-lymphotropic viruses. Members of Epsilonretrovirus include Walleye dermal sarcoma virus, and Walleye epidermal hyperplasia virus 1 and 2. Members of Gammaretrovirus include murine leukemia virus, Maloney murine leukemia virus, and feline leukemia virus, as well as viruses that infect other animal species. Lentivirus is a genus of retroviruses that cause chronic and deadly diseases, including HIV-1 and HIV-2, the cause of the disease AIDS, and also includes Simian immunodeficiency virus. The subfamily Spumaretrovirinae include the genera Bovispumavirus, Equispumavirus, Felispumavirus, Prosimiispumavirus, Simiispumavirus, and Spumavirus. Members of the Retroviridae have provided valuable research tools in molecular biology, and, in the context of the present disclosure, it has been discovered that retroviral-derived structural components of XDP can be derived from each of the genera of Retroviridae, and that the resulting XDP are capable self-assembly in a host packaging cell and encapsidating (or encompassing) therapeutic payloads that have utility in the targeted and selective delivery of the therapeutic payloads to target cells and tissues.

In some embodiments, the virus structural components are derived from a Orthoretrovirinae virus. In some embodiments, the Orthoretrovirinae virus is an Alpharetrovirus, a Betaretrovirus, a Deltaretrovirus, an Epsilonretrovirus, a Gammaretrovirus or a Lentivirus. In other embodiments, the virus structural components are derived from a Spumaretrovirinae virus. In some embodiments, the Spumaretrovirinae virus is a Bovaspumavirus, an Equispumavirus, a Felispumavirus, a Prosimiispumavirus or a Simiispumavirus In some embodiments, the XDP retroviral components are derived from an Alpharetrovirus. In such embodiments, the present disclosure provides XDP wherein the XDP comprises components selected from the group consisting of: a matrix polypeptide (MA); a p2A spacer peptide; ap2B spacer peptide; a p10 spacer peptide; a capsid polypeptide (CA); a nucleocapsid polypeptide (NC); a Gag polyprotein comprising a matrix polypeptide (MA), a capsid polypeptide (CA), p2A spacer peptide, p2B spacer peptide, p10 spacer peptide, a nucleocapsid polypeptide (NC); a therapeutic payload; a tropism factor; a Gag-Pol polyprotein; a Gag-transframe region protease polyprotein; one or more cleavage site(s); and a protease capable of cleaving the protease cleavage sites. In the forgoing embodiment, Gag components (e.g., MA, CA, p2A, p2B, p10, pp24 and NC), and optionally the cleavage site and protease, are derived from an Alpharetrovirus, including but not limited to Avian leukosis virus and Rous sarcoma virus. Representative encoding sequences for these viral components are provided in Table 10 (FIG. 115) as SEQ ID NOS: 797-806, and the methods to create the encoding plasmids and produce the XDP in host cells are described herein, below. In some embodiments, the XDP comprises Alpharetrovirus structural components encoded by the sequences selected from the group of Alpharetrovirus sequences of SEQ ID NOS: 797-806 as set forth in Table 10, or a sequence having at least 80%, at least 90%, at least 95%, at least 95%, at least 97%, at least 98%, or at least 99% identity thereto. In some embodiments, the XDP comprises one or more Alpharetrovirus structural components encoded by the Alpharetrovirus sequences of SEQ ID NOS: 797-806 as set forth in Table 10. The XDP having Alpharetrovirus components can be designed in various configurations, and may be encoded by two, three or four nucleic acids, described more fully, below. These alternative configurations are described more fully, below, as well as in the Examples. In some embodiments of the Alpharetrovirus XDP, the therapeutic payload is multiple particles of RNP of a complexed CRISPR nuclease protein and a gRNA, while the tropism factor is a viral glycoprotein embodiment described herein. In a particular embodiment of the Alpharetrovirus XDP, the therapeutic payload of an XDP are multiple particles of RNP of a complexed CasX and gRNA embodiment described herein, while the tropism factor is a viral glycoprotein embodiment described herein.

In some embodiments, the XDP viral components are derived from a Betaretrovirus. In such embodiments, the present disclosure provides XDP wherein the XDP comprises components selected from the group consisting of: a matrix polypeptide (MA); a pp21/24 spacer peptide; a p3-p8/p12 spacer peptide; a capsid polypeptide (CA); a nucleocapsid polypeptide (NC); a Gag polyprotein comprising a matrix polypeptide (MA), a capsid polypeptide (CA), pp21/24, p3-p8/p12, a nucleocapsid polypeptide (NC); a therapeutic payload; a tropism factor; a Gag-Pol polyprotein; a Gag-transframe region protease polyprotein; a protease cleavage site(s); and a protease capable of cleaving the protease cleavage sites. In the forgoing embodiment, Gag components (e.g., MA, CA, pp2124 spacer, p3-p8/p12 spacer, and NC), and optionally the cleavage site and protease, are derived from an Betaretrovirus, including but not limited to mouse mammary tumor virus, Mason-Pfizer monkey virus, and enzootic nasal tumor virus. Representative encoding sequences for these viral components are provided in Table 10 as SEQ ID NOS: 807-829, and the methods to create the encoding plasmids and produce the XDP in host cells are described herein, below. In some embodiments, the XDP comprises Betaretrovirus structural components encoded by the sequences selected from the group of Betaretrovirus sequences of SEQ ID NOS: 807-829 as set forth in Table 10, or a sequence having at least 80%, at least 90%, at least 95%, at least 95%, at least 97%, at least 98%, or at least 99% identity thereto. In some embodiments, the XDP comprises one or more Betaretrovirus structural components encoded by the Betaretrovirus sequences of SEQ ID NOS: 807-829 as set forth in Table 10. The XDP having Betaretrovirus components can be designed in various configurations, and may be encoded by two, three, four, or five nucleic acids, described more fully, below. These alternative configurations are described more fully, below, as well as in the Examples. In some embodiments of the Betaretrovirus XDP, the therapeutic payload is multiple particles of RNP of a complexed CRISPR nuclease protein and a gRNA, while the tropism factor is a viral glycoprotein embodiment described herein. In a particular embodiment of the Betaretrovirus XDP, the therapeutic payload is multiple particles of RNP of a complexed CasX and gRNA embodiment described herein, while the tropism factor is a viral glycoprotein embodiment described herein.

In some embodiments, the XDP viral components are derived from a Deltaretrovirus. In such embodiments, the present disclosure provides XDP wherein the XDP comprises components selected from the group consisting of: a matrix polypeptide (MA); a capsid polypeptide (CA); a nucleocapsid polypeptide (NC); a Gag polyprotein comprising a matrix polypeptide (MA), a capsid polypeptide (CA), and a nucleocapsid polypeptide (NC); a therapeutic payload; a tropism factor; a Gag-Pol polyprotein; a Gag-transframe region protease polyprotein; a cleavage site(s); and a protease capable of cleaving the protease cleavage sites. In the forgoing embodiment, Gag components (e.g., MA, CA, and NC), and optionally the cleavage site and protease, are derived from an Deltaretrovirus, including but not limited to bovine leukemia virus and the human T-lymphotropic viruses. Representative encoding sequences for these viral components are provided in Table 10 as SEQ ID NOS: 830-847, and the methods to create the encoding plasmids and produce the XDP in host cells are described herein, below. In some embodiments, the XDP comprises Deltaretrovirus structural components encoded by the sequences selected from the group consisting of the Deltaretrovirus sequences of SEQ ID NOS: 830-847 as set forth in Table 10, or a sequence having at least 80%, at least 90%, at least 95%, at least 95%, at least 97%, at least 98%, or at least 99% identity thereto. In some embodiments, the XDP comprises one or more Deltaretrovirus structural components encoded by the sequences selected from the group consisting of the Deltaretrovirus sequences of SEQ ID NOS: 830-847 as set forth in Table 10. The XDP having Deltaretrovirus components can be designed in various configurations, and may be encoded by two, three, four, or five nucleic acids, described more fully, below. In some embodiments, the XDP comprise a subset of the components listed supra. These alternative configurations are described more fully, below, as well as in the Examples. In some embodiments of the Deltaretrovirus XDP, the therapeutic payload is multiple particles of RNP of a complexed CRISPR nuclease protein and a gRNA, while the tropism factor is a viral glycoprotein embodiment described herein. In a particular embodiment of the Deltaretrovirus XDP, the therapeutic payload is multiple particles of RNP of a complexed CasX variant and gRNA variant embodiment described herein, while the tropism factor is a viral glycoprotein embodiment described herein.

In some embodiments, the XDP viral components are derived from Epsilonretrovirus, including but not limited to Walleye dermal sarcoma virus (WDSV), and Walleye epidermal hyperplasia virus 1 and 2. In such embodiments, the present disclosure provides XDP wherein the XDP comprises components selected from the group consisting of: a matrix polypeptide (MA); a p20 spacer peptide; a capsid polypeptide (CA); a nucleocapsid polypeptide (NC); a Gag polyprotein comprising a matrix polypeptide (MA), a capsid polypeptide (CA), p20, a nucleocapsid polypeptide (NC); a therapeutic payload; a tropism factor; a Gag-Pol polyprotein; a Gag-transframe region protease polyprotein; a cleavage site(s); and a protease capable of cleaving the protease cleavage sites. In the forgoing embodiment, Gag components (e.g., MA, CA, p20, and NC), and optionally the cleavage site and protease, are derived from an Epsilonretrovirus, including but not limited to Walleye dermal sarcoma virus, and Walleye epidermal hyperplasia virus 1 and 2. Representative encoding sequences for these viral components are provided in Table 10 as SEQ ID NOS: 848-853, and the methods to create the encoding plasmids and produce the XDP in host cells are described herein, below. In some embodiments, the XDP comprises Epsilonretrovirus structural components encoded by the sequences selected from the group consisting of the sequences of SEQ ID NOS: 848-853 as set forth in Table 10, or a sequence having at least 80%, at least 90%, at least 95%, at least 95%, at least 97%, at least 98%, or at least 99% identity thereto. In some embodiments, the XDP comprises one or more Epsilonretrovirus structural components encoded by the sequences selected from the group consisting of the sequences of SEQ ID NOS: 848-853 as set forth in Table 10. The XDP having Epsilonretrovirus components can be designed in various configurations, and may be encoded by two, three or four nucleic acids, described more fully, below. These alternative configurations are described more fully, below, as well as in the Examples. In some embodiments of the Epsilonretrovirus XDP, the therapeutic payload is multiple particles of RNP of a complexed CRISPR nuclease protein and a gRNA, while the tropism factor is a viral glycoprotein embodiment described herein. In a particular embodiment of the Epsilonretrovirus XDP, the therapeutic payload is multiple particles of RNP of a complexed CasX and gRNA embodiment described herein, while the tropism factor is a viral glycoprotein embodiment described herein.

In some embodiments, the XDP viral components are derived from Gammaretrovirus, including but not limited to murine leukemia virus (MLV), Maloney murine leukemia virus (MMLV), and feline leukemia virus (FLV). In such embodiments, the present disclosure provides XDP wherein the XDP comprises components selected from the group consisting of: a matrix polypeptide (MA); a p12 spacer peptide; a capsid polypeptide (CA); a nucleocapsid polypeptide (NC); a Gag polyprotein comprising a matrix polypeptide (MA), a p12 spacer, a capsid polypeptide (CA), a nucleocapsid polypeptide (NC); a therapeutic payload; a tropism factor; a Gag-Pol polyprotein; a Gag-transframe region protease polyprotein; a cleavage site(s); and a protease capable of cleaving the protease cleavage sites. In the forgoing embodiment, Gag components (e.g., MA, p12, CA, and NC), and optionally the cleavage site and protease, are derived from an Gammaretrovirus, including but not limited to Walleye dermal sarcoma virus, and Walleye epidermal hyperplasia virus 1 and 2. Representative encoding sequences for these viral components are provided in Table 10 as SEQ ID NOS: 854-865, and the methods to create the encoding plasmids and produce the XDP in host cells are described herein, below. In some embodiments, the XDP comprises Gammaretrovirus structural components encoded by the sequences selected from the group consisting of the sequences of SEQ ID NOS: 854-865 as set forth in Table 10, or a sequence having at least 80%, at least 90%, at least 95%, at least 95%, at least 97%, at least 98%, or at least 99% identity thereto. In some embodiments, the XDP comprises one or more Gammaretrovirus structural components encoded by the sequences selected from the group consisting of the sequences of SEQ ID NOS: 854-865 as set forth in Table 10. The XDP having Gammaretrovirus components can be designed in various configurations, and may be encoded by two, three or four nucleic acids, described more fully, below. In some embodiments, the XDP comprise a subset of the components listed supra. These alternative configurations are described more fully, below, as well as in the Examples. In some embodiments of the Gammaretrovirus XDP, the therapeutic payload is multiple particles of RNP of a complexed CRISPR nuclease protein and a gRNA, while the tropism factor is a viral glycoprotein embodiment described herein. In a particular embodiment of the Gammaretrovirus XDP, the therapeutic payload is multiple particles of RNP of a complexed CasX and gRNA embodiment described herein, while the tropism factor is a viral glycoprotein embodiment described herein.

In some embodiments, the XDP viral components are derived from Lentivirus, including but not limited to HIV-1 and HIV-2, and Simian immunodeficiency virus (SIV). In such embodiments, the present disclosure provides XDP wherein the XDP comprises components selected from the group consisting of: a matrix polypeptide (MA); a capsid (CA), a p2 spacer peptide, a nucleocapsid (NC), a p1 spacer peptide, a p6 spacer peptide; a Gag polyprotein comprising a matrix polypeptide (MA), CA, p2, NC, a p1 spacer peptide, a p6 spacer peptide; a therapeutic payload; a tropism factor; a Gag-Pol polyprotein; a Gag-transframe region protease polyprotein; a cleavage site(s); and a protease capable of cleaving the protease cleavage sites. In the forgoing embodiment, Gag components (e.g., MA, CA, NC, a p1 spacer peptide, and a p6 spacer peptide), and optionally the cleavage site and protease, are derived from an Lentivirus, including but not limited to HIV-1, HIV-2, and Simian immunodeficiency virus (SIV). Representative encoding sequences for these viral components are provided in Table 10 as SEQ ID NOS: 917-922 and 1859-1865, and the methods to create the encoding plasmids and produce the XDP in host cells are described herein, below. In some embodiments, the XDP comprises Lentivirus structural components encoded by the sequences selected from the group consisting of the sequences of as SEQ ID NOS: 917-922 and 1859-1865 as set forth in Table 10, or a sequence having at least 80%, at least 90%, at least 95%, at least 95%, at least 97%, at least 98%, or at least 99% identity thereto. In some embodiments, the XDP comprises one or more Lentivirus structural components encoded by the sequences selected from the group consisting of the sequences of as SEQ ID NOS: 917-922 and 1859-1865 as set forth in Table 10. The XDP having Lentivirus components can be designed in various configurations, and may be encoded by two, three, four, or five nucleic acids, described more fully, below. These alternative configurations are described more fully, below, as well as in the Examples. In some embodiments of the Lentivirus XDP, the therapeutic payload is multiple particles of RNP of a complexed CRISPR nuclease protein and a gRNA, while the tropism factor is a viral glycoprotein embodiment described herein. In a particular embodiment of the Lentivirus XDP, the therapeutic payload is multiple particles of RNP of a complexed CasX variant and gRNA variant embodiment described herein, while the tropism factor is a viral glycoprotein embodiment described herein.

In some embodiments, the XDP viral components are derived from Spumaretrovirinae, including but not limited to Bovispumavirus, Equispumavirus, Felispumavirus, Prosimiispumavirus, Simiispumavirus, and Spumavirus. In such cases, the present disclosure provides XDP wherein the XDP comprises components selected from the group consisting of: p68 Gag; a p3 Gag; a Gag polyprotein comprising of p68 Gag and p3 gag; a therapeutic payload; a tropism factor; a Gag-transframe region protease polyprotein; a cleavage site (s); and a protease capable of cleaving the protease cleavage sites. In the forgoing embodiment, Gag components (e.g., p68 AND p3p20), and optionally the cleavage site and protease, are derived from an Spumaretrovirinae including but not limited to Bovispumavirus, Equispumavirus, Felispumavirus, Prosimiispumavirus, Simiispumavirus, and Spumavirus. Representative encoding sequences for these viral components are provided in Table 10 as SEQ ID NOS: 896-916, and the methods to create the encoding plasmids and produce the XDP in host cells are described herein, below. In some embodiments, the XDP comprises Spumaretrovirinae structural components encoded by the sequences selected from the group consisting of the sequences of SEQ ID NOS: 896-916 as set forth in Table 10, or a sequence having at least 80%, at least 90%, at least 95%, at least 95%, at least 97%, at least 98%, or at least 99% identity thereto. In some embodiments, the XDP comprises one or more Spumaretrovirinae structural components encoded by the sequences selected from the group consisting of the sequences of SEQ ID NOS: 896-916 as set forth in Table 10. The XDP having Spumaretrovirus components can be designed in various configurations, and may be encoded by two, three, four, or five nucleic acids, described more fully, below. These alternative configurations are described more fully, below, as well as in the Examples. In some embodiments of the Spumaretrovirinae XDP, the therapeutic payload is multiple particles of RNP of a complexed CRISPR nuclease protein and a gRNA, while the tropism factor is a viral glycoprotein embodiment described herein. In a particular embodiment of the Spumaretrovirinae XDP, the therapeutic payload is multiple particles of RNP of a complexed CasX variant and gRNA variant embodiment described herein, while the tropism factor is a viral glycoprotein embodiment described herein.

In other embodiments, the present disclosure provides XDP wherein the retroviral components of the XDP are selected from different genera of the Retroviridae. Thus the XDP can comprise two or more components selected from a matrix polypeptide (MA), a p2A spacer peptide, a p2B spacer peptide; a p10 spacer peptide, a capsid polypeptide (CA), a nucleocapsid polypeptide (NC), a pp21/24 spacer peptide, a p3-P8 spacer peptide, a p12 spacer peptide, a p20 spacer peptide, a p1 spacer peptide, a p6 spacer peptide, a p68 Gag, a p3 Gag, a cleavage site(s), a Gag-Pol polyprotein; a Gag-transframe region protease polyprotein; and a protease capable of cleaving the protease cleavage sites wherein the components are derived from Alpharetrovirus, Betaretrovirus, Deltaretrovirus, Epsilonretrovirus, Gammaretrovirus, Lentivirus, Bovispumavirus, Equispumavirus, Felispumavirus, Prosimiispumavirus, Simiispumavirus, or Spumavirus.

In the XDP retroviral components derived from HIV-1, the accessory protein integrase (or its encoding nucleic acid) can be omitted from the XDP systems, as well as the HIV functional accessory genes vpr, vpx (HIV-2), which are dispensable for viral replication in vitro. Additionally, the nucleic acids of the XDP system do not require reverse transcriptase for the creation of the XDP compositions of the embodiments. Thus, in one embodiment, the HIV-1 Gag-Pol component of the XDP can be truncated to Gag linked to the transframe region (TFR) composed of the transframe octapeptide (TFP) and 48 amino acids of the p6pol, separated by a protease cleavage site, hereinafter referred to as Gag-TFR-PR, described more fully, below.

b. Proteases

In some embodiments of the XDP systems, the protease capable of cleaving the protease cleavage sites is selected from a retroviral protease, including any of the genera of the Retroviridae. For example, the protease can be encoded by a sequence selected from the group consisting of the sequences of SEQ ID NOS: 801, 806, 811, 817, 823, 829, 833, 839, 845, 852, 858, 864, 869, 875, 881, 887, 893, 897, 900, 903, 906, 909, 912, 915, and 1865 as set forth in Table 10, or a sequence having at least 80%, at least 90%, at least 95%, at least 95%, at least 97%, at least 98%, or at least 99% identity thereto. In other embodiments, the protease capable of cleaving the protease cleavage sites is a non-retroviral, heterologous ("heterologous" meaning not from a retrovirus) protease selected from the group of proteases consisting of tobacco etch virus protease (TEV), potyvirus HC protease, potyvirus P1 protease, PreScission (HRV3C protease), b virus NIa protease, B virus RNA-2-encoded protease, aphthovirus L protease, enterovirus 2A protease, rhinovirus 2A protease, picorna 3C protease, comovirus 24K protease, nepovirus 24K protease, RTSV (rice tungro spherical virus) 3C-like protease, PYVF (parsnip yellow fleck virus) 3C-like protease, heparin, cathepsin, thrombin, factor Xa, metalloproteinases (including MMP-2, -3, -7, -9, -10, and -11), and enterokinase. In a particular embodiment, the protease capable of cleaving the protease cleavage sites is PreScission Protease; a fusion protein of human rhinovirus (HRV) 3C protease and glutathione S-transferase (GST). In another particular embodiment, the protease capable of cleaving the protease cleavage sites is tobacco etch virus protease (TEV). In another particular embodiment, the protease capable of cleaving the protease cleavage sites is HIV-1 protease. In the case of HIV-1 protease, the 99-amino acid protease (PR) of the precursor Gag-Pol polyprotein (which are encoded by overlapping open reading frames such that the synthesis of the of the Gag-Pol precursor results from a −1 frameshifting event) is flanked at its N-terminus by a transframe region (TFR) composed of the transframe octapeptide (TFP) and 48 amino acids of the p6pol, separated by a protease cleavage site. Cleavage at the p6pol-PR site to release a free N-terminus of protease is concomitant with the appearance of enzymatic activity and formation of a stable tertiary structure that is characteristic of the mature protease (Louis, J M. Et al. Autoprocessing of HIV-1 protease is tightly coupled to protein folding. Nat Struct Mol Biol 6, 868-875 (1999)). In some embodiments of the XDP systems, wherein the nucleic acid encodes all or a portion of the HIV-1 Gag-Pol polyprotein, the Gag-Pol sequence comprises the encoded TFR-PR to facilitate the −1 frameshifting event. In some cases, wherein the XDP system utilizes a component comprised of the Gag polyprotein and a portion of the pol polyprotein of just the TFR and the protease, the component is referred to herein as "Gag-TFR-PR" or "Gag-TFR-PR polyprotein" or Gag-transframe region protease polyprotein", wherein the capability to facilitate the −1 frameshifting event is retained, along with the capability to produce the encoded protease. In non-limiting examples of nucleic acids encoding a Retroviral protease that can be incorporated into a Gag-encoding plasmid of the XDP system embodiments, representative sequences are provided in Table 10 as SEQ ID NOS: 801, 806, 811, 817, 823, 829, 833, 839, 845, 852, 858, 864, 869, 875, 881, 887, 893, 897, 900, 903, 906, 909, 912, 915, and 1865.

In a corresponding fashion, wherein protease cleavage sites are incorporated in the XDP systems, the protease cleavage sites utilized in the encoded proteins of the XDPs and their encoding sequences in the nucleic acids will correlate with the protease that is incorporated into the XDP system. In some embodiments, the protease cleavage site of the XDP component comprising all or a portion of a Gag polyprotein is located between the Gag polyprotein and the therapeutic payload such that upon maturation of the XDP particle, the therapeutic payload is not tethered to any component of the Gag polyprotein. In other embodiments, the protease cleavage site is incorporated between the individual components of the Gag polyprotein as well as between the Gag polyprotein and the therapeutic payload. In a representative embodiment, wherein the protease capable of cleaving the protease cleavage sites is TEV, the encoded TEV protease cleavage sites can have the sequences EXXYXQ(G/S) (SEQ ID NO: 17), ENLYFQG (SEQ ID NO: 18) or ENLYFQS (SEQ ID NO: 19), wherein X represents any amino acid and cleavage by TEV occurs between Q and G or Q and S. In another embodiment, wherein the protease is HIV-1 protease, the encoded HIV-1 cleavage sites can have the sequence SQNYPIVQ (SEQ ID NO: 20). In another embodiment, wherein the protease is PreScission, the protease cleavage sites include the core amino acid sequence Leu-Phe-Gln/Gly-Pro, cleaving between the Gln and Gly residues. In one embodiment, the XDP comprising cleavage sites have protease cleavage sites that are identical. In another embodiment, the XDP comprising cleavage sites have protease cleavage sites that are different and are substrates for different proteases. In another embodiment, the XDP system can comprise a cleavage sequence that is susceptible to cleavage by two different proteases; e.g., HIV-1 and PreScission protease. In such cases, the nucleic acids encoding the XDP would include encoding sequences for both proteases.

Additional protease cleavage sites are envisaged as within the scope of the XDP of the instant invention.

III. PROTEIN AND NUCLEIC ACID THERAPEUTIC PAYLOADS OF THE XDP SYSTEMS

Protein therapeutic payloads suitable for inclusion in the XDP of the present disclosure include a diversity of categories of protein-based therapeutics, including, but not limited to cytokines (e.g., interferons (IFNs) α, β, and γ, TNF-α, G-CSF, GM-CSF)), interleukins (e.g., IL-1 to IL-40), growth factors (e.g., VEGF, PDGF, IGF-1, EGF, and TGF-β), enzymes, receptors, microproteins, hormones (e.g., growth hormone, insulin), erythropoietin, RNAses, DNAses, blood clotting factors (e.g. FVII, FVIII, FIX, FX), anticoagulants, bone morphogenetic proteins, engineered protein scaffolds, thrombolytics (e.g., streptokinase, tissue plasminogen activator, plasminogen, and plasmid), CRISPR proteins (Class 2 Type II, Type V, or Type VI), transcription factors, repressor factors (such as, but not limited to, Krüppel-associated box (KRAB), DNA methyltransferase 3 alpha (DNMT3A), DNMT3A-like protein (DNMT3L), DNA methyltransferase 3 beta (DNMT3B), DNA methyltransferase 1 (DNMT1), Friend of GATA-1 (FOG), and Mad mSIN3 interaction domain (SID)), transposons, reverse transcriptase, viral interferon antagonists, tick proteins, as well as engineered proteins such as anti-cancer modalities or biologics intended to treat diseases such as neurologic, metabolic, cardiovascular, liver, renal, or endocrine diseases and disorders, or any combination of the foregoing. Nucleic acid payloads suitable for inclusion in the XDP of the present disclosure include a diversity of categories, including sequences encoding the foregoing protein therapeutic payloads, as well as single-stranded antisense oligonucleotides (ASOs), double-stranded RNA interference (RNAi) molecules, DNA aptamers, RNA aptamers, nucleic acids utilized in gene therapy (e.g., guide RNAs utilized in CRISPR systems and donor templates), micro RNAs, ribozymes, RNA decoys, circular RNAs, or any combination of the foregoing. In some embodiments, the payload of the XDP comprises ribonucleoprotein particles (RNP) of a CRISPR Class 2 nuclease and a gRNA. In particular embodiments, the payload of the XDP comprises a RNP of a CasX protein of any of the embodiments described herein, including the CasX variants comprising sequences of SEQ ID NOS: 135-457, 937-950, 1884-1929 or 35044-35047 as set forth in Tables 3 and 12, and a guide RNA of any of the embodiments described herein, including the gRNA variants with a scaffold sequences of SEQ ID NOS: 1959-2010 and 2238-2377 as set forth in Table 8 and, optionally, a donor template.

a. CRISPR Proteins of the XDP Systems

In some embodiments, the present disclosure provides XDP compositions and systems comprising a CRISPR nuclease and one or more guide nucleic acids engineered to bind target nucleic acid that have utility in genome editing of eukaryotic cells.

The XDP compositions, systems, and methods described in greater detail herein can be designed and adapted for use with Class 2 CRISPR systems. Thus, in some embodiments, the CRISPR system utilized in the XDP is a Class 2 CRISPR system. Class 2 systems are distinguished from Class 1 systems in that they have a single, large, multi-domain effector protein. In certain embodiments, the Class 2 system utilized in the XDP can be a Type II, Type V, or Type VI system. Each type of Class 2 system is further divided into subtypes. Class 2, Type II systems can be divided into 4 subtypes: II-A, II-B, II-C1, and II-C2. Class 2, Type V systems can be divided into 17 subtypes: V-A, V-B1, V-B2, V-C, V-D, V-E, V-F1, V-F1 (V-U3), V-F2, V-F3, V-G, V-H, V-I, V-K (V-U5), V-U1, V-U2, and V-U4. Class 2, Type VI systems can be divided into 5 subtypes: VI-A, VI-B1, VI-B2, VI-C, and VI-D.

The nucleases of Type V systems differ from Type II effectors (e.g., Cas9), which contain two nuclear domains that are each responsible for the cleavage of one strand of the target DNA, with the HNH nuclease inserted inside the Ruv-C like nuclease domain sequence. The Type V nucleases possess a single RNA-guided RuvC domain-containing effector but no HNH domain, and they recognize a T-rich protospacer adjacent motif (PAM) 5' upstream to the target region on the non-targeted strand, which is different from Cas9 systems which rely on G-rich PAM at 3' side of target sequences. Type V nucleases generate staggered double-stranded breaks distal to the PAM sequence, unlike Cas9, which generates a blunt end in the proximal site close to the PAM. In addition, Type V nucleases degrade ssDNA in trans when activated by target dsDNA or ssDNA binding in cis. In some embodiments, the Type V nucleases utilized in the XDP embodiments recognize a 5' TC PAM motif and produce staggered ends cleaved by the RuvC domain. The Type V systems (e.g., Cas12) only contain a RuvC-like nuclease domain that cleaves both strands. Type VI (Cas13) are unrelated to the effectors of Type II and V systems and contain two HEPN domains and target RNA.

In some embodiments, the Class 2 system utilized in the XDP is a Type II system. In some embodiments, the Type II CRISPR system utilized in the XDP is a II-A CRISPR system. In some embodiments, the Type II CRISPR system utilized in the XDP is a II-B CRISPR system. In some embodiments, the Type II CRISPR system utilized in the XDP is a II-C1 CRISPR system. In some embodiments, the Type II CRISPR system utilized in the XDP is a II-C2 CRISPR system. In some embodiments, the Type II system utilized in the XDP is a Cas9 system.

In some embodiments, the Class 2 system utilized in the XDP is a Type V system. In some embodiments, the Type V CRISPR system utilized in the XDP is a V-A CRISPR system. In some embodiments, the Type V CRISPR system utilized in the XDP is a V-B1 CRISPR system. In some embodiments, the Type V CRISPR system utilized in the XDP is a V-B2 CRISPR system. In some embodiments, the Type V CRISPR system is a V-C CRISPR system. In some embodiments, the Type V CRISPR system utilized in the XDP is a V-D CRISPR system. In some embodiments, the Type V CRISPR system utilized in the XDP is a V-E CRISPR system. In some embodiments, the Type V CRISPR system utilized in the XDP is a V-F1 CRISPR system. In some embodiments, the Type V CRISPR system utilized in the XDP is a V-F1 (V-U3) CRISPR system. In some embodiments, the Type V CRISPR system utilized in the XDP is a V-F2 CRISPR system. In some embodiments, the Type V CRISPR system utilized in the XDP is a V-F3 CRISPR system. In some embodiments, the Type V CRISPR system utilized in the XDP is a V-G CRISPR system. In some embodiments, the Type V CRISPR system is a V-H CRISPR system. In some embodiments, the Type V CRISPR system utilized in the XDP is a V-I CRISPR system. In some embodiments, the Type V CRISPR system is a V-K (V-U5) CRISPR system. In some embodiments, the Type V CRISPR system utilized in the XDP is a V-U1 CRISPR system. In some embodiments, the Type V CRISPR system utilized in the XDP is a V-U2 CRISPR system. In some embodiments, the Type V CRISPR system utilized in the XDP is a V-U4 CRISPR system. In some embodiments, the Type V CRISPR system utilized in the XDP is selected from the group consisting of Cas12a (Cpf1), Cas12b (C2c1), Cas12c (C2c3), Cas12d (CasY), Cas12e (CasX), Cas12f, Cas12g, Cas12h, Cas12i, Cas12j, Cas12k, Cas14, and CasΦ.

In some embodiments the Class 2 system utilized in the XDP is a Type VI system. In some embodiments, the Type VI CRISPR system utilized in the XDP is a VI-A CRISPR system. In some embodiments, the Type VI CRISPR system utilized in the XDP is a VI-B 1 CRISPR system. In some embodiments, the Type VI CRISPR system utilized in the XDP is a VI-B2 CRISPR system. In some embodiments, the Type VI CRISPR system utilized in the XDP is a VI-C CRISPR system. In some embodiments, the Type VI CRISPR system utilized in the XDP is a VI-D CRISPR system. In some embodiments, the Type VI CRISPR system utilized in the XDP is selected from Cas13a (C2c2), Cas13b (Group 29/30), Cas13c, and/or Cas13d.

In some embodiments, the present disclosure provides XDP comprising a ribonucleoprotein (RNP) of a complexed CasX protein and one or more guide ribonucleic acids (gRNA) that are specifically designed to modify a target nucleic acid sequence in eukaryotic cells. In a particular embodiment, the present disclosure provides XDP comprising a ribonucleoprotein (RNP) of a complexed CasX variant protein and a gRNA variant that are specifically designed to incorporate an increased number of RNPs into the XDP particles. In the embodiment, the XDP are configured to include one or more non-covalent recruitment (NCR) proteins and a cognate ligand in the gRNA so that the individual particles comprise at least about 100 RNP, at least about 200 RNP, at least about 300 RNP, at least about 400 RNP, at least about 500 RNP, at least about 600 RNP, at least about 700 RNP, at least about 800 RNP, at least about 900 RNP, or at least about 1000 RNP. In some embodiments, the XDP are configured so that the individual particles comprise at least about 100 to about 1000 RNP, at least about 200 to about 800 RNP, or at least about 400 to about 600 RNP.

The term "CasX protein", as used herein, refers to a family of proteins, and encompasses all naturally occurring CasX proteins (also referred to herein as a "wild-type" or "reference" CasX), as well as CasX variants with one or more modifications in at least one domain relative to a naturally-occurring reference CasX protein.

CasX proteins of the disclosure comprise at least one of the following domains: a non-target strand binding (NTSB) domain, a target strand loading (TSL) domain, a helical I domain (which is further divided into helical I-I and I-II subdomains), a helical II domain, an oligonucleotide binding domain (OBD, which is further divided into OBD-I and OBD-II subdomains), and a RuvC DNA cleavage domain (which is further divided into RuvC-I and II subdomains). The RuvC domain may be modified or deleted in a catalytically dead CasX variant, described more fully, below.

In some embodiments, a CasX protein can bind and/or modify (e.g., nick, catalyze a double strand break, methylate, demethylate, etc.) a target nucleic acid at a specific sequence targeted by an associated gRNA, which hybridizes to a sequence within the target nucleic acid sequence.

b. Reference CasX Proteins

The disclosure provides naturally-occurring CasX proteins (referred to herein as a "reference CasX protein"), which were subsequently modified to create the CasX variants of the disclosure. For example, reference CasX proteins can be isolated from naturally occurring prokaryotes, such as Deltaproteobacteria, Planctomycetes, or Candidatus Sungbacteria species. A reference CasX protein (interchangeably referred to herein as a reference CasX polypeptide) is a type II CRISPR/Cas endonuclease belonging to the CasX (interchangeably referred to as Cas12e) family of proteins that interacts with a guide RNA to form a ribonucleoprotein (RNP) complex.

In some cases, a Type V reference CasX protein is isolated or derived from Deltaproteobacteria having a sequence of:

```
                                        (SEQ ID NO: 1)
  1  MEKRINKIRK KLSADNATKP VSRSGPMKTL LVRVMTDDLK

KRLEKRRKKP EVMPQVISNN

61  AANNLRMLLD DYTKMKEAIL QVYWQEFKDD HVGLMCKFAQ

PASKKIDQNK LKPEMDEKGN

121  LTTAGFACSQ CGQPLFVYKL EQVSEKGKAY TNYFGRCNVA

EHEKLILLAQ LKPEKDSDEA

181  VTYSLGKFGQ RALDFYSIHV TKESTHPVKP LAQIAGNRYA

SGPVGKALSD ACMGTIASFL

241  SKYQDIIIEH QKVVKGNQKR LESLRELAGK ENLEYPSVTL

PPQPHTKEGV DAYNEVIARV

301  RMWVNLNLWQ KLKLSRDDAK PLLRLKGFPS FPVVERRENE

VDWWNTINEV KKLIDAKRDM

361  GRVFWSGVTA EKRNTILEGY NYLPNENDHK KREGSLENPK

KPAKRQFGDL LLYLEKKYAG

421  DWGKVFDEAW ERIDKKIAGL TSHIEREEAR NAEDAQSKAV

LTDWLRAKAS FVLERLKEMD

481  EKEFYACEIQ LQKWYGDLRG NPFAVEAENR VVDISGFSIG

SDGHSIQYRN LLAWKYLENG

541  KREFYLLMNY GKKGRIRFTD GTDIKKSGKW QGLLYGGGKA

KVIDLTFDPD DEQLIILPLA

601  FGTRQGREFI WNDLLSLETG LIKLANGRVI EKTIYNKKIG

RDEPALFVAL TFERREVVDP

661  SNIKPVNLIG VDRGENIPAV IALTDPEGCP LPEFKDSSGG

PTDILRIGEG YKEKQRAIQA

721  AKEVEQRRAG GYSRKFASKS RNLADDMVRN SARDLFYHAV

THDAVLVFEN LSRGFGRQGK

781  RTFMTERQYT KMEDWLTAKL AYEGLTSKTY LSKTLAQYTS

KTCSNCGFTI TTADYDGMLV

841  RLKKTSDGWA TTLNNKELKA EGQITYYNRY KRQTVEKELS

AELDRLSEES GNNDISKWTK

901  GRRDEALFLL KKRFSHRPVQ EQFVCLDCGH EVHADEQAAL

NIARSWLFLN SNSTEFKSYK

961  SGKQPFVGAW QAFYKRRLKE VWKPNA.
```

In some cases, a Type V reference CasX protein is isolated or derived from Planctomycetes having a sequence of:

```
                                        (SEQ ID NO: 2)
  1  MQEIKRINKI RRRLVKDSNT KKAGKTGPMK TLLVRVMTPD

LRERLENLRK KPENIPQPIS

61  NTSRANLNKL LTDYTEMKKA ILHVYWEEFQ KDPVGLMSRV

AQPAPKNIDQ RKLIPVKDGN

121  ERLTSSGFAC SQCCQPLYVY KLEQVNDKGK PHTNYFGRCN

VSEHERLILL SPHKPEANDE

181  LVTYSLGKFG QRALDFYSIH VTRESNHPVK PLEQIGGNSC

ASGPVGKALS DACMGAVASF

241  LTKYQDIILE HQKVIKKNEK RLANLKDIAS ANGLAFPKIT

LPPQPHTKEG IEAYNNVVAQ

301  IVIWVNLNLW QKLKIGRDEA KPLQRLKGFP SFPLVERQAN

EVDWWDMVCN VKKLINEKKE

361  DGKVFWQNLA GYKRQEALLP YLSSEEDRKK GKKFARYQFG

DLLLHLEKKH GEDWGKVYDE

421  AWERIDKKVE GLSKHIKLEE ERRSEDAQSK AALTDWLRAK

ASFVIEGLKE ADKDEFCRCE

481  LKLQKWYGDL RGKPFAIEAE NSILDISGFS KQYNCAFIWQ

KDGVKKLNLY LIINYFKGGK

541  LRFKKIKPEA FEANRFYTVI NKKSGEIVPM EVNFNFDDPN

LIILPLAFGK RQGREFIWND

601  LLSLETGSLK LANGRVIEKT LYNRRTQDE PALFVALTFE

RREVLDSSNI KPMNLIGIDR

661  GENIPAVIAL TDPEGCPLSR FKDSLGNPTH ILRIGESYKE

KQRTIQAAKE VEQRRAGGYS
```

-continued

```
721  RKYASKAKNL ADDMVRNTAR DLLYYAVTQD AMLIFENLSR
     GFGRQGKRTF MAERQYTRME
781  DWLTAKLAYE GLPSKTYLSK TLAQYTSKTCSNCGFTITSA
     DYDRVLEKLK KTATGWMTTI
841  NGKELKVEGQ ITYYNRYKRQ NVVKDLSVEL DRLSEESVNN
     DISSWTKGRS GEALSLLKKR
901  FSHRPVQEKF VCLNCGFETH ADEQAALNIA RSWLFLRSQE
     YKKYQTNKTT GNTDKRAFVE
961  TWQSFYRKKL KEVWKPAV.
```

In some cases, a Type V reference CasX protein is isolated or derived from Candidatus Sungbacteria having a sequence of

```
                                        (SEQ ID NO: 3)
  1  MDNANKPSTK SLVNTTRISD HFGVTPGQVT RVFSFGIIPT
     KRQYAIIERW FAAVEAARER
 61  LYGMLYAHFQ ENPPAYLKEK FSYETFFKGR PVLNGLRDID
     PTIMTSAVFT ALRHKAEGAM
121  AAFHTNHRRL FEEARKKMRE YAECLKANEA LLRGAADIDW
     DKIVNALRTR LNTCLAPEYD
181  AVIADFGALC AFRALIAETN ALKGAYNHAL NQMLPALVKV
     DEPEEAEESP RLRFFNGRIN
241  DLPKFPVAER ETPPDTETII RQLEDMARVI PDTAEILGYI
     HRIRHKAARR KPGSAVPLPQ
301  RVALYCAIRM ERNPEEDPST VAGHFLGEID RVCEKRRQGL
     VRTPFDSQIR ARYMDIISFR
361  ATLAHPDRWT EIQFLRSNAA SRRVRAETIS APFEGFSWTS
     NRTNPAPQYG MALAKDANAP
421  ADAPELCICL SPSSAAFSVR EKGGDLIYMR PTGGRRGKDN
     PGKEITWVPG SFDEYPASGV
481  ALKLRLYFGR SQARRMLTNK TWGLLSDNPR VFAANAELVG
     KKRNPQDRWK LFFHMVISGP
541  PPVEYLDFSS DVRSRARTVI GINRGEVNPL AYAVVSVEDG
     QVLEEGLLGK KEYIDQLIET
601  RRRISEYQSR EQTPPRDLRQ RVRHLQDTVL GSARAKIHSL
     IAFWKGILAI ERLDDQFHGR
661  EQKIIPKKTY LANKTGFMNA LSFSGAVRVD KKGNPWGGMI
     EIYPGGISRT CTQCGTVWLA
721  RRPKNPGHRD AMVVIPDIVD DAAATGFDNV DCDAGTVDYG
     ELFTLSREWV RLTPRYSRVM
781  RGTLGDLERA IRQGDDRKSR QMLELALEPQ PQWGQFFCHR
     CGFNGQSDVL AATNLARRAI
841  SLIRRLPDTD TPPTP.
``` c. CasX Variant Proteins

In some embodiments of the XDP systems, the disclosure provides CasX variant proteins for use in the XDP wherein the CasX variants comprise one or more modifications in one or more domains relative to the reference CasX protein, including but not limited to the sequences of SEQ ID NOS: 1-3, or one or more modifications relative to another CasX variant from which it was derived. Any change in amino acid sequence of a reference CasX protein that leads to an improved characteristic of the CasX protein is considered a CasX variant protein of the disclosure. For example, CasX variants can comprise one or more amino acid substitutions, insertions, deletions, or swapped domains, or any combinations thereof, relative to a reference CasX protein sequence. Any permutation of the substitution, insertion and deletion embodiments described herein can be combined to generate a CasX variant protein of the disclosure.

The CasX variants of the disclosure have one or more improved characteristics compared to a reference CasX protein of SEQ ID NO: 1, SEQ ID NO: 2 or SEQ ID NO: 3, or the variant from which it was derived; e.g. CasX 491 or CasX 515. Exemplary improved characteristics of the CasX variant embodiments include, but are not limited to improved folding of the variant, improved binding affinity to the gRNA, improved binding affinity to the target nucleic acid, improved ability to utilize a greater spectrum of PAM sequences in the editing and/or binding of target nucleic acid, improved unwinding of the target DNA, increased editing activity, improved editing efficiency, improved editing specificity for the target nucleic acid, decreased off-target editing or cleavage, increased percentage of a eukaryotic genome that can be efficiently edited, increased activity of the nuclease, increased target strand loading for double strand cleavage, decreased target strand loading for single strand nicking, improved binding of the non-target strand of DNA, improved protein stability, improved protein:gRNA (RNP) complex stability, and improved fusion characteristics. Exemplary improved characteristics are described in WO2020247882A1 and PCT/US20/36505, incorporated by reference herein. In the foregoing embodiments, the one or more of the improved characteristics of the CasX variant is at least about 1.1 to about 100,000-fold improved relative to the reference CasX protein of SEQ ID NO: 1, SEQ ID NO: 2, or SEQ ID NO: 3, or alternatively to CasX 491 (SEQ ID NO: 189) or CasX 515 (SEQ ID NO: 196) when assayed in a comparable fashion. In other embodiments, the improvement is at least about 1.1-fold, at least about 2-fold, at least about 5-fold, at least about 10-fold, at least about 50-fold, at least about 100-fold, at least about 500-fold, at least about 1000-fold, at least about 5000-fold, at least about 10,000-fold, or at least about 100,000-fold compared to the reference CasX protein of SEQ ID NO: 1, SEQ ID NO: 2, or SEQ ID NO: 3, or CasX 491 (SEQ ID NO: 189) or CasX 515 (SEQ ID NO: 196) when assayed in a comparable fashion. In other cases, the one or more improved characteristics of an RNP of the CasX variant and the gRNA variant are at least about 1.1, at least about 10, at least about 100, at least about 1000, at least about 10,000, at least about 100,000-fold or more improved relative to an RNP of the reference CasX protein of SEQ ID NO: 1, SEQ ID NO: 2, or SEQ ID NO: 3 and the reference gRNA of SEQ ID NOS: 4-16 of Table 7 or the RNP of CasX 491 (SEQ ID NO: 189) or CasX 515 (SEQ ID NO: 196) and gRNA variants of SEQ ID NOS: 1959-2010 or 2238-2377 of Table 8, optionally with gRNA 174 (SEQ ID NO: 2238). In other cases, the one or more of the improved characteristics of an RNP of the CasX variant and the gRNA variant are about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold improved relative to an RNP of the reference CasX protein of SEQ ID NO:1, SEQ ID NO:2, or SEQ ID NO:3 and the reference gRNA of SEQ ID NOS: 4-16 of Table 7 or the RNP of CasX 491 (SEQ ID NO: 189) or CasX 515 (SEQ ID NO: 196) and gRNA variants of SEQ ID NOS: 1959-2010 or 2238-2377 of Table 8, optionally with gRNA 174 (SEQ ID NO: 2238), when assayed in a comparable fashion.

An exemplary improved characteristic includes improved editing efficiency, wherein an RNP of a CasX variant and a gRNA variant exhibit an improved cleavage rate of a target nucleic acid of at least 2-fold, at least 3-fold, at least 4-fold, at least 5-fold, at lease 6-fold, at least 7-fold, at least 8-fold, or at least 10-fold or greater compared to an RNP of a reference CasX and reference gRNA, when assayed in vitro under comparable conditions, as demonstrated in the Examples, below. In some embodiments of the XDP system, the RNP of a CasX variant and a gRNA variant at a concentration of 20 pM or less, is capable of cleaving a double stranded DNA target with an efficiency of at least 40%, at least 50%, at least 60%, at least 70%, at least 80%, at least 85%, at least 90% or at least 95%. In some embodiments of the XDP system, the RNP of a CasX variant and a gRNA variant at a concentration of 50 pM or less, 40 pM or less, 30 pM or less, 20 pM or less, 10 pM or less, or 5 pM or less, is capable of cleaving a double stranded DNA target with an efficiency of at least 40%, at least 50%, at least 60%, at least 70%, at least 80%, at least 85%, at least 90% or at least 95%, greatly exceeding the performance of RNP of an RNP of a reference CasX and reference gRNA. The improved editing efficiency of the CasX variants, in combination with the gRNA variants of the disclosure, make them well-suited for inclusion in the XDP of the disclosure compared to a reference CasX and reference gRNA.

In some embodiments, the modification of the CasX variant is a mutation in one or more amino acids of the reference CasX. In other embodiments, the modification is an insertion or substitution of a part or all of a domain from a different CasX protein. In a particular embodiment, the CasX variants of 514-791, corresponding to SEQ ID NOS: 176 and 195-457 have a NTSB and helical Ib domain of SEQ ID NO: 1, while the other domains are derived from SEQ ID NO: 2, in addition to individual modifications in select domains, described herein. Mutations can be introduced in any one or more domains of the reference CasX protein or in a CasX variant to result in a CasX variant, and may include, for example, deletion of part or all of one or more domains, or one or more amino acid substitutions, deletions, or insertions in any domain of the reference CasX protein or the CasX variant from which it was derived.

In some embodiments, the CasX variant protein comprises at least one modification in at least 1 domain, in at least each of 2 domains, in at least each of 3 domains, in at least each of 4 domains or in at least each of 5 domains of the reference CasX protein, including the sequences of SEQ ID NOS: 1-3, or a CasX variant from which it was derived.

In other embodiments, the disclosure provides CasX variants for use in the XDP wherein the CasX variants comprise at least one modification relative to another CasX variant; e.g., CasX variant 515 (SEQ ID NO: 196) and 527 (SEQ ID NO: 207) is a variant of CasX variant 491 (SEQ ID NO: 189) and CasX variants 668 (SEQ ID NO: 347) and 672 (SEQ ID NO: 350) are variants of CasX 535 (SEQ ID NO: 215). In some embodiments, the at least one modification is selected from the group consisting of an amino acid insertion, deletion, or substitution. All variants that improve one or more functions or characteristics of the CasX variant protein when compared to a reference CasX protein or the variant from which it was derived described herein are envisaged as being within the scope of the disclosure. A CasX variant can be mutagenized to create another CasX variant. In a particular embodiment, described more fully, below, the disclosure provides variants of CasX 515 created by introducing modifications to the encoding sequence resulting in amino acid substitutions, deletions, or insertions at one or more positions in one or more domains, including, but not limited to the modifications of the sequences of Tables 100-103.

Suitable mutagenesis methods for generating CasX variant proteins of the disclosure may include, for example, Deep Mutational Evolution (DME), deep mutational scanning (DMS), error prone PCR, cassette mutagenesis, random mutagenesis, staggered extension PCR, gene shuffling, or domain swapping (described in PCT/US20/36506 and WO2020247883A2, incorporated by reference herein). In some embodiments, the CasX variants are designed, for example by selecting multiple desired mutations in a CasX variant identified using assays described in the Examples. In certain embodiments, the activity of a reference CasX or the CasX variant protein prior to mutagenesis is used as a benchmark against which the activity of one or more resulting CasX variants are compared, thereby measuring improvements in function of the new CasX variants.

The CasX variants of the embodiments described herein have the ability to form an RNP complex with the gRNA variants disclosed herein, including during the encapsidation process of the XDP as the components are expressed in the transfected packaging host cells disclosed herein. The CasX variant proteins of the disclosure have an enhanced ability to efficiently edit and/or bind target DNA, when complexed with a gRNA variant as an RNP, utilizing a PAM TC motif, including PAM sequences selected from TTC, ATC, GTC, or CTC, compared to an RNP of a reference CasX protein and reference gRNA. In the foregoing, the PAM sequence is located at least 1 nucleotide 5' to the non-target strand of the protospacer having identity with the targeting sequence of the gRNA variant in an assay system compared to the editing efficiency and/or binding of an RNP comprising a reference CasX protein and reference gRNA in a comparable assay system. In one embodiment, an RNP of a CasX variant and gRNA variant exhibits greater editing efficiency and/or binding of a target sequence in the target DNA compared to an RNP comprising a reference CasX protein and a reference gRNA in a comparable assay system, wherein the PAM sequence of the target DNA is TTC. In another embodiment, an RNP of a CasX variant and gRNA variant exhibits greater editing efficiency and/or binding of a target sequence in the target DNA compared to an RNP comprising a reference CasX protein and a reference gRNA in a comparable assay system, wherein the PAM sequence of the target DNA is ATC. In another embodiment, an RNP of a CasX variant and gRNA variant exhibits greater editing efficiency and/or binding of a target sequence in the target DNA compared to an RNP comprising a reference CasX protein and a reference gRNA in a comparable assay system, wherein the PAM sequence of the target DNA is CTC. In another embodiment, an RNP of a CasX variant and gRNA variant exhibits greater editing efficiency and/or binding of a target sequence in the target DNA compared to an RNP comprising a reference CasX protein and a reference gRNA in a comparable assay system, wherein the PAM sequence of the target DNA is GTC. In the foregoing embodiments, the increased editing efficiency and/or binding affinity for the one or more PAM sequences is at least 1.5-fold greater or more compared to the editing efficiency and/or binding affinity of an RNP of any one of the CasX proteins of SEQ ID NOS:1-3 and the gRNA of Table 7 for the PAM sequences.

The term "CasX variant" is inclusive of variants that are fusion proteins; i.e., the CasX is "fused to" a heterologous sequence. This includes CasX variants comprising CasX variant sequences and N-terminal, C-terminal, or internal fusions of the CasX to a heterologous protein or domain thereof.

In some embodiments, the CasX variant protein comprises between 400 and 2000 amino acids, between 500 and 1500 amino acids, between 700 and 1200 amino acids, between 800 and 1100 amino acids or between 900 and 1000 amino acids.

d. CasX Variant Proteins with Domains from Multiple Source Proteins

Also contemplated within the scope of the disclosure are XDP comprising chimeric CasX variant proteins comprising protein domains from two or more different CasX proteins, such as two or more naturally occurring CasX proteins, or two or more CasX variant protein sequences as described herein. As used herein, a "chimeric CasX protein" refers to a CasX variant containing at least two domains isolated or derived from different sources, such as two naturally occurring proteins, which may, in some embodiments, be isolated from different species. In a particular embodiment, the CasX variants of 514-791 have a NTSB and helical 1B domain derived from the sequence of SEQ ID NO: 1, while the other domains are derived from SEQ ID NO: 2, it being understood that the variants have additional amino acid changes at select locations. In another particular, embodiment, the CasX variant of 494 (SEQ ID NO: 190) has a NTSB domain derived from the sequence of SEQ ID NO: 1, while the other domains are derived from SEQ ID NO: 2.

In some embodiments of the XDP systems, a CasX variant protein comprises at least one chimeric domain comprising a first part from a first CasX protein and a second part from a second, different CasX protein. As used herein, a "chimeric domain" refers to a domain containing at least two parts isolated or derived from different sources, such as two naturally occurring proteins or portions of domains from two reference CasX proteins. The at least one chimeric domain can be any of the NTSB, TSL, helical I, helical II, OBD or RuvC domains as described herein. As an example of the foregoing, the chimeric RuvC domain comprises amino acids 661 to 824 of SEQ ID NO: 1 and amino acids 922 to 978 of SEQ ID NO: 2. As an alternative example of the foregoing, a chimeric RuvC domain comprises amino acids 648 to 812 of SEQ ID NO: 2 and amino acids 935 to 986 of SEQ ID NO: 1. In the case of split or non-contiguous domains such as helical I, RuvC and OBD, a portion of the non-contiguous domain can be replaced with the corresponding portion from any other source. For example, the helical I-I domain (sometimes referred to as helical I-a) in SEQ ID NO: 2 can be replaced with the corresponding helical I-I sequence from SEQ ID NO: 1, and the like. Domain sequences from reference CasX proteins, and their coordinates, are shown in Table 1. Representative examples of chimeric CasX proteins include the variants of CasX 485-491 and 515, corresponding to SEQ ID NOS: 183-189, and 196, the sequences of which are set forth in Table 3.

TABLE 1

Domain coordinates in Reference CasX proteins

| Domain Name | Coordinates in SEQ ID NO: 1 | Coordinates in SEQ ID NO: 2 |
| --- | --- | --- |
| OBD a | 1-55 | 1-57 |
| helical I a | 56-99 | 58-101 |
| NTSB | 100-190 | 102-191 |
| helical I b | 191-331 | 192-332 |
| helical II | 332-508 | 333-500 |
| OBD b | 509-659 | 501-646 |
| RuvC a | 660-823 | 647-810 |
| TSL | 824-933 | 811-920 |
| RuvC b | 934-986 | 921-978 |

*OBD a and b, helical I a and b, and RuvC a and b are also referred to herein as OBD I and II, helical I-I and I-II, and RuvC I and II.

Exemplary domain sequences are provided in Table 2 below.

TABLE 2

Exemplary Domain Sequences in Reference CasX proteins

| SEQ ID | Domain | Sequence |
| --- | --- | --- |
| | | *Deltaproteobacter* sp. (reference CasX of SEQ ID NO: 1) |
| 1866 | OBD-I | EKRINKIRKKLSADNATKPVSRSGPMKTLLVRVMTDDLKKRLEKRRKKPEVMPQ |
| 1867 | helical I-I | VISNNAANNLRMLLDDYTKMKEAILQVYWQEFKDDHVGLMCKFA |
| 1868 | NTSB | QPASKKIDQNKLKPEMDEKGNLTTAGFACSQCGQPLFVYKLEQVSEKGKAYTNYFGRCNV AEHEKLILLAQLKPEKDSDEAVTYSLGKFGQ |
| 1869 | helical I-II | RALDFYSIHVTKESTHPVKPLAQIAGNRYASGPVGKALSDACMGTIASFLSKYQDIIIEH QKVVKGNQKRLESLRELAGKENLEYPSVTLPPQPHTKEGVDAYNEVIARVRMWVNLNLWQ KLKLSRDDAKPLLRLKGFPSF |
| 1870 | helical II | PVVERRENEVDWWNTINEVKKLIDAKRDMGRVFWSGVTAEKRNTILEGYNYLPNENDHKK REGSLENPKKPAKRQFGDLLLYLEKKYAGDWGKVFDEAWERIDKKIAGLTSHIEREEARN AEDAQSKAVLTDWLRAKASFVLERLKEMDEKEFYACEIQLQKWYGDLRG NPFAVEAE |
| 1871 | OBD-II | NRVVDISGFSIGSDGHSIQYRNLLAWKYLENGKREFYLLMNYGKKGRIRFTDGTDIKKSG KWQGLLYGGGKAKVIDLTFDPDDEQLIILPLAFGTRQGREFIWNDLLSLETGLIKLANGR VIEKTIYNKKIG RDEPALFVALTFERREVVD |
| 1872 | RuvC-I | PSNIKPVNLIGVDRGENIPAVIALTDPEGCPLPEFKDSSGGPTDILRIGEGYKEKQRAIQ AAKEVEQRRAGGYSRKFASKSRNLADDMVRNSARDLFYHAVTHDAVLVFENLSRGFGRQG KRTFMTERQYTKMEDWLTAKLAYEGLTSKTYLSKTLAQYTSKTC |
| 1873 | TSL | SNCGFTITTADYDGMLVRLKKTSDGWATTLNNKELKAEGQITYYNRYKRQTVEKELSAEL DRLSEESGNNDISKWTKGRRDEALFLLKKRFSHRPVQEQFVCLDCGHEVH |

TABLE 2-continued

Exemplary Domain Sequences in Reference CasX proteins

| SEQ ID | Domain | Sequence |
|---|---|---|
| 1874 | RuvC-II | ADEQAALNIARSWLFLN SNSTEFKSYKSGKQPFVGAWQAFYKRRLKEVWKPNA |

*Planctomycetes* sp. (Reference CasX of SEQ ID NO: 2)

| SEQ ID | Domain | Sequence |
|---|---|---|
| 1875 | OBD-I | QEIKRINKIRRRLVKDSNTKKAGKTGPMKTLLVRVMTPDLRERLENLRKKPENIPQ |
| 1876 | helical I-II | PISNTSRANLNKLLTDYTEMKKAILHVYWEEFQKDPVGLMSRVA |
| 1877 | NTSB | QPAPKNIDQRKLIPVKDGNERLTSSGFACSQCCQPLYVYKLEQVNDKGKPHTNYFGRCNV SEHERLILLSPHKPEANDELVTYSLGKFGQ |
| 1878 | helical I-II | RALDFYSIHVTRESNHPVKPLEQIGGNSCASGPVGKALSDACMGAVASFLTKYQDIILEH QKVIKKNEKRLANLKDIASANGLAFPKITLPPQPHTKEGIEAYNNVVAQIVIWVNLNLWQ KLKIGRDEAKPLQRLKGFPSF |
| 1879 | helical II | PLVERQANEVDWWDMVCNVKKLINEKKEDGKVFWQNLAGYKRQEALLPYLSSEEDRKKGK KFARYQFGDLLLHLEKKHGEDWGKVYDEAWERIDKKVEGLSKHIKLEEERRSEDAQSKAA LTDWLRAKASFVIEGLKEADKDEFCRCELKLQKWYGDLRGKPFAIEAE |
| 1880 | OBD-II | NSILDISGFSKQYNCAFIWQKDGVKKLNLYLIINYFKGGKLRFKKIKPEAFEANRFYTVI NKKSGEIVPMEVNFNFDDPNLIILPLAFGKRQGREFIWNDLLSLETGSLK LANGRVIEKTLYNRRTRQDEPALFVALTFERREVLD |
| 1881 | RuvC-I | SSNIKPMNLIGIDRGENIPAVIALTDPEGCPLSRFKDSLGNPTHILRIGESYKEKQRTIQ AAKEVEQRRAGGYSRKYASKAKNLADDMVRNTARDLLYYAVTQDAMLIFENLSRGFGRQG KRTFMAERQYTRMEDWLTAKLAYEGLPSKTYLSKTLAQYTSKTC |
| 1882 | TSL | SNCGFTITSADYDRVLEKLKKTATGWMTTINGKELKVEGQITYYNRYKRQNVVKDLSVEL DRLSEESVNNDISSWTKGRSGEALSLLKKRFSHRPVQEKFVCLNCGFETH |
| 1883 | RuvC-II | ADEQAALNIARSWLFLRSQEYKKYQTNKTTGNTDKRAFVETWQSFYRKKLKEVWKPAV | e. Exemplary CasX Variants

In some embodiments, a CasX variant protein utilized in the XDP comprises a sequence as set forth in Tables 3 and 12. In other embodiments, a CasX variant protein utilized in the XDP comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical to a sequence of SEQ ID NOS: 135-457, 937-950, 1884-1929 or 35044-35047 as set forth in Tables 3 and 12, wherein the variant retains the ability to form an RNP with a gRNA and retains nuclease activity. In a particular embodiment, comprises a sequence selected from the group consisting of SEQ ID NOS: 189, 196, 347, 350, 354, and 1901, as set forth in Table 3. In other embodiments, a CasX variant protein utilized in the XDP comprises a sequence SEQ ID NOS: 135-457, 937-950, 1884-1929 or 35044-35047 set forth in Table 3 or Table 12, and further comprises one or more NLS disclosed herein at or near either the N-terminus, the C-terminus, or both. It will be understood that in some cases, the N-terminal methionine of the CasX variants of the Tables is removed from the expressed CasX variant during post-translational modification.

TABLE 3

CasX Variant Sequences

| SEQ ID NO | Variant No. |
|---|---|
| 135 | 119 |
| 136 | 429 |
| 137 | 430 |
| 138 | 431 |
| 139 | 432 |
| 140 | 433 |
| 141 | 434 |
| 142 | 435 |
| 143 | 436 |
| 144 | 437 |
| 145 | 438 |
| 146 | 439 |
| 147 | 440 |
| 148 | 441 |
| 149 | 442 |
| 150 | 443 |
| 151 | 444 |
| 152 | 445 |
| 153 | 446 |
| 154 | 447 |
| 155 | 448 |
| 156 | 449 |
| 157 | 450 |
| 158 | 451 |
| 159 | 452 |
| 160 | 453 |
| 161 | 454 |
| 162 | 455 |
| 163 | 456 |
| 164 | 457 |
| 165 | 458 |
| 166 | 459 |
| 167 | 460 |
| 168 | 278 |
| 169 | 279 |
| 170 | 280 |
| 171 | 285 |
| 172 | 286 |
| 173 | 287 |
| 174 | 288 |
| 175 | 290 |
| 179 | 492 |
| 180 | 493 |
| 181 | 387 |

TABLE 3-continued

CasX Variant Sequences

| SEQ ID NO | Variant No. |
|---|---|
| 182 | 395 |
| 183 | 485 |
| 184 | 486 |
| 185 | 487 |
| 186 | 488 |
| 187 | 489 |
| 188 | 490 |
| 189 | 491 |
| 190 | 494 |
| 191 | 328 |
| 192 | 388 |
| 193 | 389 |
| 194 | 390 |
| 195 | 514 |
| 196 | 515 |
| 197 | 516 |
| 198 | 517 |
| 199 | 518 |
| 200 | 519 |
| 201 | 520 |
| 202 | 522 |
| 203 | 523 |
| 204 | 524 |
| 205 | 525 |
| 206 | 526 |
| 207 | 527 |
| 208 | 528 |
| 209 | 529 |
| 210 | 530 |
| 211 | 531 |
| 212 | 532 |
| 213 | 533 |
| 214 | 534 |
| 215 | 535 |
| 216 | 536 |
| 217 | 537 |
| 218 | 538 |
| 219 | 539 |
| 220 | 540 |
| 221 | 541 |
| 222 | 542 |
| 223 | 543 |
| 224 | 544 |
| 225 | 545 |
| 226 | 546 |
| 227 | 547 |
| 228 | 548 |
| 229 | 550 |
| 230 | 551 |
| 231 | 552 |
| 232 | 553 |
| 233 | 554 |
| 234 | 555 |
| 235 | 556 |
| 236 | 557 |
| 237 | 558 |
| 238 | 559 |
| 239 | 560 |
| 240 | 561 |
| 241 | 562 |
| 242 | 563 |
| 243 | 564 |
| 244 | 565 |
| 245 | 566 |
| 246 | 567 |
| 247 | 568 |
| 248 | 569 |
| 249 | 570 |
| 250 | 571 |
| 251 | 572 |
| 252 | 573 |
| 253 | 574 |
| 254 | 575 |
| 255 | 576 |
| 256 | 577 |
| 257 | 578 |
| 258 | 579 |
| 259 | 580 |
| 260 | 581 |
| 261 | 582 |
| 262 | 583 |
| 263 | 584 |
| 264 | 585 |
| 265 | 586 |
| 266 | 587 |
| 267 | 588 |
| 268 | 589 |
| 269 | 590 |
| 270 | 591 |
| 271 | 592 |
| 272 | 593 |
| 273 | 594 |
| 274 | 595 |
| 275 | 596 |
| 276 | 597 |
| 277 | 598 |
| 278 | 599 |
| 279 | 600 |
| 280 | 601 |
| 281 | 602 |
| 282 | 603 |
| 283 | 604 |
| 284 | 605 |
| 285 | 606 |
| 286 | 607 |
| 287 | 608 |
| 288 | 609 |
| 289 | 610 |
| 290 | 611 |
| 291 | 612 |
| 292 | 613 |
| 293 | 614 |
| 294 | 615 |
| 295 | 616 |
| 296 | 617 |
| 297 | 618 |
| 298 | 619 |
| 299 | 620 |
| 300 | 621 |
| 301 | 622 |
| 302 | 623 |
| 303 | 624 |
| 304 | 625 |
| 305 | 626 |
| 306 | 627 |
| 307 | 628 |
| 308 | 629 |
| 309 | 630 |
| 310 | 631 |
| 311 | 632 |
| 312 | 633 |
| 313 | 634 |
| 314 | 635 |
| 315 | 636 |
| 316 | 637 |
| 317 | 638 |
| 318 | 639 |
| 319 | 640 |
| 320 | 641 |
| 321 | 642 |
| 322 | 643 |
| 323 | 644 |
| 324 | 645 |
| 325 | 646 |
| 326 | 647 |
| 327 | 648 |
| 328 | 649 |
| 329 | 650 |
| 330 | 651 |
| 331 | 652 |
| 332 | 653 |
| 333 | 654 |

TABLE 3-continued

CasX Variant Sequences

| SEQ ID NO | Variant No. |
|---|---|
| 334 | 655 |
| 335 | 656 |
| 336 | 657 |
| 337 | 658 |
| 338 | 659 |
| 339 | 660 |
| 340 | 661 |
| 341 | 662 |
| 342 | 663 |
| 343 | 664 |
| 344 | 665 |
| 345 | 666 |
| 346 | 667 |
| 347 | 668 |
| 348 | 669 |
| 176 | 670 |
| 349 | 671 |
| 350 | 672 |
| 351 | 673 |
| 352 | 674 |
| 353 | 675 |
| 354 | 676 |
| 355 | 677 |
| 356 | 678 |
| 357 | 679 |
| 358 | 680 |
| 359 | 681 |
| 360 | 682 |
| 361 | 683 |
| 362 | 684 |
| 363 | 685 |
| 364 | 686 |
| 365 | 687 |
| 366 | 688 |
| 367 | 689 |
| 368 | 690 |
| 369 | 691 |
| 370 | 692 |
| 371 | 693 |
| 372 | 694 |
| 373 | 701 |
| 374 | 702 |
| 375 | 703 |
| 376 | 704 |
| 377 | 705 |
| 378 | 706 |
| 379 | 707 |
| 380 | 708 |
| 381 | 709 |
| 382 | 710 |
| 383 | 711 |
| 384 | 712 |
| 385 | 713 |
| 386 | 714 |
| 387 | 715 |
| 388 | 716 |
| 389 | 717 |
| 390 | 718 |
| 391 | 719 |
| 392 | 720 |
| 393 | 721 |
| 394 | 722 |
| 395 | 723 |
| 396 | 724 |
| 397 | 725 |
| 398 | 726 |
| 399 | 727 |
| 400 | 728 |
| 401 | 729 |
| 402 | 730 |
| 403 | 731 |
| 404 | 732 |
| 405 | 733 |
| 406 | 734 |
| 407 | 735 |
| 408 | 736 |
| 409 | 737 |
| 410 | 738 |
| 411 | 739 |
| 412 | 740 |
| 413 | 741 |
| 414 | 742 |
| 415 | 743 |
| 416 | 744 |
| 417 | 745 |
| 418 | 746 |
| 419 | 747 |
| 420 | 748 |
| 421 | 749 |
| 422 | 750 |
| 423 | 751 |
| 424 | 752 |
| 425 | 753 |
| 426 | 754 |
| 427 | 755 |
| 428 | 756 |
| 429 | 757 |
| 430 | 758 |
| 431 | 759 |
| 432 | 760 |
| 433 | 761 |
| 434 | 762 |
| 435 | 763 |
| 436 | 764 |
| 437 | 765 |
| 438 | 766 |
| 439 | 767 |
| 440 | 768 |
| 441 | 769 |
| 442 | 770 |
| 443 | 777 |
| 444 | 778 |
| 445 | 779 |
| 446 | 780 |
| 447 | 781 |
| 448 | 782 |
| 449 | 783 |
| 450 | 784 |
| 451 | 785 |
| 452 | 786 |
| 453 | 787 |
| 454 | 788 |
| 455 | 789 |
| 456 | 790 |
| 457 | 791 |
| 177 | 793 |
| 178 | 794 |
| 1884 | 795 |
| 1885 | 796 |
| 1886 | 797 |
| 1887 | 798 |
| 1888 | 799 |
| 1889 | 800 |
| 1890 | 801 |
| 1891 | 802 |
| 1892 | 803 |
| 1893 | 804 |
| 1894 | 805 |
| 1895 | 806 |
| 1896 | 807 |
| 1897 | 808 |
| 1898 | 809 |
| 1899 | 810 |
| 1900 | 811 |
| 1901 | 812 |
| 1902 | 813 |
| 1903 | 814 |
| 1904 | 815 |
| 1905 | 816 |
| 1906 | 817 |
| 1907 | 818 |
| 1908 | 819 |

TABLE 3-continued

CasX Variant Sequences

| SEQ ID NO | Variant No. |
|---|---|
| 1909 | 820 |
| 1910 | 821 |
| 1911 | 822 |
| 1912 | 823 |
| 1913 | 824 |
| 1914 | 825 |
| 1915 | 826 |
| 1916 | 827 |
| 1917 | 828 |
| 1918 | 829 |
| 1919 | 830 |
| 1920 | 831 |
| 1921 | 832 |
| 1922 | 833 |
| 1923 | 834 |
| 1924 | 835 |
| 1925 | 836 |
| 1926 | 837 |
| 1927 | 838 |
| 1928 | 839 |
| 1929 | 840 |

Additional CasX variants for incorporation into the XDP of the disclosure are provided as SEQ ID NOS: 100-134.

f. CasX Variant Derived from Other CasX Variants

In further iterations of the generation of variant proteins, a variant protein can be utilized to generate additional CasX variants of the disclosure. For example, CasX 119 (SEQ ID NO: 135), CasX 491 (SEQ ID NO: 189), and CasX 515 (SEQ ID NO: 196) are exemplary variant proteins that are modified to generate additional CasX variants of the disclosure having improvements or additional properties relative to a reference CasX, or the CasX variants from which they were derived. CasX 119 contains a substitution of L379R, a substitution of A708K and a deletion of P at position 793 of SEQ ID NO: 2. CasX 491 contains an NTSB and Helical 1B domain swap from SEQ ID NO: 1. CasX 515 was derived from CasX 491 by insertion of P at position 793 (relative to SEQ ID NO: 2) and was used to create the CasX variants described in Example 36. For example, CasX 668 (SEQ ID NO: 347) has an insertion of R at position 26 and a substitution of G223S relative to CasX 515. CasX 672 (SEQ ID NO: 350) has substitutions of L169K and G223S relative to CasX 515. CasX 676 (SEQ ID NO: 354) has substitutions of L169K and G223S and an insertion of R at position 26 relative to CasX 515.

Exemplary methods used to generate and evaluate CasX variants derived from other CasX variants are described in the Examples, which were created by introducing modifications to the encoding sequence resulting in amino acid substitutions, deletions, or insertions at one or more positions in one or more domains of the CasX variant. In particular, Example 36 describes the methods used to create variants of CasX 515 (SEQ ID NO: 196) that were then assayed to determine those positions in the sequence that, when modified by an amino acid insertion, deletion or substitution, resulted in an enrichment or improvement in the assays. For purposes of the disclosure, the sequences of the domains of CasX 515 are provided in Table 4 and include an OBD-I domain having the sequence of SEQ ID NO: 1930, an OBD-II domain having the sequence of SEQ ID NO: 1935, NTSB domain having the sequence of SEQ ID NO: 1932, a helical I-I domain having the sequence of SEQ ID NO: 1931, a helical I-II domain having the sequence of SEQ ID NO: 1933, a helical II domain having the sequence of SEQ ID NO: 1934, a RuvC-I domain having the sequence of SEQ ID NO: 1936, a RuvC-II domain having the sequence of SEQ ID NO: 1938, and a TSL domain having the sequence of SEQ ID NO: 1937. By the methods of the disclosure, individual positions in the domains of CasX 515 were modified, assayed, and the resulting positions and exemplary modifications leading to an enrichment or improvement that follow are provided, relative to their position in each domain or subdomain. In some cases, such positions are disclosed in Tables 100-103 of the Examples. In some embodiments, the disclosure provides CasX variants derived from CasX 515 comprising one or more modifications (i.e., an insertion, a deletion, or a substitution) at one or more amino acid positions in the NTSB domain relative to SEQ ID NO: 1932 selected from the group consisting of P2, S4, Q9, E15, G20, G33, L41, Y51, F55, L68, A70, E75, K88, and G90, wherein the modification results in an improved characteristic relative to CasX 515. In a particular embodiment, the one or more modifications at one or more amino acid positions in the NTSB domain are selected from the group consisting of ^G2, ^I4, ^L4, Q9P, E15S, G20D, [S30], G33T, L41A, Y51T, F55V, L68D, L68E, L68K, A70Y, A70S, E75A, E75D, E75P, K88Q, and G90Q (where "^" represents and insertion and "[ ]" represents a deletion at that position). In some embodiments, the disclosure provides CasX variants derived from CasX 515 comprising one or more modifications at one or more amino acid positions in the helical I-II domain relative to SEQ ID NO: 1933 selected from the group consisting of I24, A25, Y29 G32, G44, S48, S51, Q54, I56, V63, S73, L74, K97, V100, M112, L116, G137, F138, and S140, wherein the modification results in an improved characteristic relative to CasX 515. In a particular embodiment, the one or more modifications at one or more amino acid positions in the helical I-II domain are selected from the group consisting of ^T24, ^C25, Y29F, G32Y, G32N, G32H, G32S, G32T, G32A, G32V, [G32], G325, G32T, G44L, G44H, S48H, S48T, S51T, Q54H, I56T, V63T, S73H, L74Y, K97G, K97S, K97D, K97E, V100L, M112T, M112W, M112R, M112K, L116K, G137R, G137K, G137N, ^Q138, and S140Q. In some embodiments, the disclosure provides CasX variants derived from CasX 515 comprising one or more modifications at one or more amino acid positions in the helical II domain relative to SEQ ID NO: 1934 selected from the group consisting of L2, V3, E4, R5, Q6, A7, E9, V10, D11, W12, W13, D14, M15, V16, C17, N18, V19, K20, L22, I23, E25, K26, K31, Q35, L37, A38, K41, R42, Q43, E44, L46, K57, Y65, G68, L70, L71, L72, E75, G79, D81, W82, K84, V85, Y86, D87, I93, K95, K96, E98, L100, K102, I104, K105, E109, R110, D114, K118, A120, L121, W124, L125, R126, A127, A129, I133, E134, G135, L136, E138, D140, K141, D142, E143, F144, C145, C147, E148, L149, K150, L151, Q152, K153, L158, E166, and A167, wherein the modification results in an improved characteristic relative to CasX 515. In a particular embodiment, the one or more modifications at one or more amino acid positions in the helical II domain are selected from the group consisting of ^A2, ^H2, [L2]+[V3], V3E, V3Q, V3F, [V3], ^D3, V3P, E4P, [E4], E4D, E4L, E4R, R5N, Q6V, ^Q6, ^G7, ^H9, ^A9, VD10, ^T10, [V10], ^F10, ^D11, [D11], D11S, [W12], W12T, W12H, ^P12, ^Q13, ^G12, ^R13, W13P, W13D, ^D13, W13L, ^P14, ^D14, [D14]+[M15], [M15], ^T16, ^P17, N181, V19N, V19H, K20D, L22D, I23S, E25C, E25P, ^G25, K26T, K27E, K31L, K31Y, Q35D, Q35P, ^S37, [L37]+ [A38], K41L, ^R42, [Q43]+[E44], L46N, K57Q, Y65T, G68M, L70V, L71C, L72D, L72N, L72W, L72Y, E75F, E75L, E75Y, G79P, ^E79, ^T81, ^R81, ^W81, ^82, ^Y82, W82G, W82R, K84D, K84H, K84P, K84T, V85L, V85A, ˆL85, Y86C, D87G, D87M, D87P, I93C, K95T, K96R, E98G, L100A, K102H, I104T, I104S, I104Q, K105D, ˆK109, E109L, R110D, [R110], D114E, ˆD114, K118P, A120R, L121T, W124L, L125C, R126D, A127E, A127L, A129T, A129K, I133E, ˆC133, ˆS134, ˆG134, ˆR135, G135P, L136K, L136D, L136S, L136H, [E138], D140R, ˆD140, ˆP141, ˆD142, [E143]+[F144], ˆQ143, F144K, [F144], [F144]+[C145], C145R, ˆG145, C145K, C147D, ˆV148, E148D, ˆH149, L149R, K150R, L151H, Q152C, K153P, L158S, E166L, and ˆF167. In some embodiments, the disclosure provides CasX variants derived from CasX 515 comprising one or more modifications at one or more amino acid positions in the RuvC-I domain relative to SEQ ID NO: 1936 selected from the group consisting of I4, K5, P6, M7, N8, L9, V12, G49, K63, K80, N83, R90, M125, and L146, wherein the modification results in an improved characteristic relative to CasX 515. In a particular embodiment, the one or more modifications at one or more amino acid positions in the RuvC-I domain are selected from the group consisting of ˆI4, ˆS5, ˆT6, ˆN6, ˆR7, ˆK7, ˆH8, ˆS8, V12L, G49W, G49R, S51R, S51K, K62S, K62T, K62E, V65A, K80E, N83G, R90H, R90G, M125S, M125A, L137Y, ˆP137, [L141], L141R, L141D, ˆQ142, ˆR143, ˆN143, E144N, ˆP146, L146F, P147A, K149Q, T150V, ˆR152, ˆH153, T155Q, ˆH155, ˆR155, ˆL156, [L156], ˆW156, ˆA157, ˆF157, ˆ157S, Q158K, [Y159], T160Y, T160F, ˆI161, S161P, T163P, ˆN163, C164K, and C164M. In some embodiments, the disclosure provides CasX variants derived from CasX 515 comprising one or more modifications at one or more amino acid positions in the OBD-I domain relative to SEQ ID NO: 1930 selected from the group consisting of I4, K5, P6, M7, N8, L9, V12, G49, K63, K80, N83, R90, M125, and L146, wherein the modification results in an improved characteristic relative to CasX 515. In a particular embodiment, the one or more modifications at one or more amino acid positions in the OBD-I domain are selected from the group consisting of ˆG3, I3G, 13E, ˆG4, K4G, K4P, K4S, K4W, K4W, R5P, ˆP5, ˆG5, R5S, ˆS5, R5A, RˆP, RˆG, RˆL, I6A, I6L, ˆG6, N7Q, N7L, N7S, K8G, K15F, D16W, ˆF16, ˆF18, ˆP27, M28P, M28H, V33T, R34P, M36Y, R41P, L47P, ˆP48, E52P, ˆP55, [P55]+[Q56], Q56S, Q56P, ˆD56, ˆT56, and Q56P. In some embodiments, the disclosure provides CasX variants derived from CasX 515 comprising one or more modifications at one or more amino acid positions in the OBD-II domain relative to SEQ ID NO: 1935 selected from the group consisting of I4, K5, P6, M7, N8, L9, V12, G49, K63, K80, N83, R90, M125, and L146, wherein the modification results in an improved characteristic relative to CasX 515. In a particular embodiment, the one or more modifications at one or more amino acid positions in the OBD-II domain are selected from the group consisting of [S2], I3R, I3K, [I3]+[L4], [L4], K11T, ˆP24, K37G, R42E, ˆS53, ˆR58, [K63], M70T, I82T, Q92I, Q92F, Q92V, Q92A, ˆA93, K110Q, R115Q, L121T, ˆA124, ˆR141, ˆD143, ˆA143, ˆW144, and ˆA145. In some embodiments, the disclosure provides CasX variants derived from CasX 515 comprising one or more modifications at one or more amino acid positions in the TSL domain relative to SEQ ID NO: 1937 selected from the group consisting of S1, N2, C3, G4, F5, I7, K18, V58, S67, T76, G78, S80, G81, E82, S85, V96, and E98, wherein the modification results in an improved characteristic relative to CasX 515. In a particular embodiment, the one or more modifications at one or more amino acid positions in the TSL domain are selected from the group consisting of ˆM1, [N2], ˆV2, C3S, ˆG4, ˆW4, F5P, ˆW7, K18G, V58D, ˆA67, T76E, T76D, T76N, G78D, [S80], [G81], ˆE82, ˆN82, S85I, V96C, V96T, and E98D. It will be understood that combinations of any of the same foregoing modifications of the paragraph can similarly be introduced into the CasX variants of the disclosure, resulting in a CasX variant with improved characteristics. For example, in one embodiment, the disclosure provides CasX variant 535 (SEQ ID NO: 215), which has a single mutation of G223S relative to CasX 515. In another embodiment, the disclosure provides CasX variant 668 (SEQ ID NO: 347), which has an insertion of R at position 26 and a substitution of G223S relative to CasX 515. In another embodiment, the disclosure provides CasX 672 (SEQ ID NO: 350), which has substitutions of L169K and G223S relative to CasX 515. In another embodiment, the disclosure provides CasX 676 (SEQ ID NO: 354), which has substitutions of L169K and G223S and an insertion of R at position 26 relative to CasX 515. CasX variants with improved characteristics relative to CasX 515 include variants of Table 3.

Exemplary characteristics that can be improved in CasX variant proteins relative to the same characteristics in reference CasX proteins or relative to the CasX variant from which they were derived include, but are not limited to improved folding of the variant, increased binding affinity to the gRNA, increased binding affinity to the target nucleic acid, improved ability to utilize a greater spectrum of PAM sequences in the editing and/or binding of target nucleic acid, improved unwinding of the target DNA, increased editing activity, improved editing efficiency, improved editing specificity for the target nucleic acid, decreased off-target editing or cleavage, increased percentage of a eukaryotic genome that can be efficiently edited, increased activity of the nuclease, increased target strand loading for double strand cleavage, decreased target strand loading for single strand nicking, increased binding of the non-target strand of DNA, improved protein stability, improved protein:gRNA (RNP) complex stability, and improved fusion characteristics. In a particular embodiment, as described in the Examples, such improved characteristics can include, but are not limited to, improved cleavage activity in target nucleic acids having TTC, ATC, and CTC PAM sequences, increased specificity for cleavage of a target nucleic acid sequence, and decreased off-target cleavage of a target nucleic acid.

TABLE 4

CasX 515 domain sequences

| Domain | SEQ ID NO | Amino Acid Sequence |
| --- | --- | --- |
| ODB-I | 1930 | QEIKRINKIRRRLVKDSNTKKAGKTGPMKTLLVRVMTPDLRERLENLRK KPENIPQ |

TABLE 4-continued

CasX 515 domain sequences

| Domain | SEQ ID NO | Amino Acid Sequence |
|---|---|---|
| Helical I-I | 1931 | PISNTSRANLNKLLTDYTEMKKAILHVYWEEFQKDPVGLMSRVA |
| NTSB | 1932 | QPASKKIDQNKLKPEMDEKGNLTTAGFACSQCGQPLFVYKLEQVSEKGK AYTNYFGRCNVAEHEKLILLAQLKPEKDSDEAVTYSLGKFGQ |
| Helical I-II | 1933 | RALDFYSIHVTKESTHPVKPLAQIAGNRYASGPVGKALSDACMGTIASF LSKYQDIIIEHQKVVKGNQKRLESLRELAGKENLEYPSVTLPPQPHTKE GVDAYNEVIARVRMWVNLNLWQKLKLSRDDAKPLLRLKGFPSF |
| Helical II | 1934 | PLVERQANEVDWWDMVCNVKKLINEKKEDGKVFWQNLAGYKRQEALRPY LSSEEDRKKGKKFARYQLGDLLLHLEKKHGEDWGKVYDEAWERIDKKVE GLSKHIKLEEERRSEDAQSKAALTDWLRAKASFVIEGLKEADKDEFCRC ELKLQKWYGDLRGKPFAIEAE |
| OBD-II | 1935 | NSILDISGFSKQYNCAFIWQKDGVKKLNLYLIINYFKGGKLRFKKIKPE AFEANRFYTVINKKSGEIVPMEVNFNFDDPNLIILPLAFGKRQGREFIW NDLLSLETGSLKLANGRVIEKTLYNRRTRQDEPALFVALTFERREVLD |
| RuvC-I | 1936 | SSNIKPMNLIGVDRGENIPAVIALTDPEGCPLSRFKDSLGNPTHILRIG ESYKEKQRTIQAKKEVEQRRAGGYSRKYASKAKNLADDMVRNTARDLLY YAVTQDAMLIFENLSRGFGRQGKRTFMAERQYTRMEDWLTAKLAYEGLP SKTYLSKTLAQYTSKTC |
| TSL | 1937 | SNCGFTITSADYDRVLEKLKKTATGWMTTINGKELKVEGQITYYNRYKR QNVVKDLSVELDRLSEESVNNDISSWTKGRSGEALSLLKKRFSHRPVQE KFVCLNCGFETH |
| RuvC-II | 1938 | ADEQAALNIARSWLFLRSQEYKKYQTNKTTGNTDKRAFVETWQSFYRKK LKEVWKPAV | g. CasX Fusion Proteins

Also contemplated within the scope of the disclosure are XDP comprising CasX variant proteins comprising a heterologous protein fused to the CasX. This includes CasX variants comprising N-terminal, C-terminal, or internal fusions of the CasX to a heterologous protein or domain thereof. In some embodiments, the CasX variant protein is fused to one or more proteins or domains thereof that has a different activity of interest, resulting in a fusion protein. For example, in some embodiments, the CasX variant protein is fused to a protein (or domain thereof) that inhibits transcription, modifies a target nucleic acid, or modifies a polypeptide associated with a nucleic acid (e.g., histone modification). This includes CasX variants comprising N-terminal, C-terminal, or internal fusions of the CasX to a heterologous protein or domain thereof.

A variety of heterologous polypeptides are suitable for inclusion in a CasX variant fusion protein utilized in the XDP systems of the disclosure. In some cases, the fusion partner can recruit gRNA in order to facilitate the formation of the RNP complex between the CasX variant and the guide nucleic acid, as well as facilitate the trafficking of the RNP into the budding XDP assembling in the packaging host cell. Such fusion partners include RNA binding proteins such as MS2 coat protein, PP7 coat protein, Qβ, boxB, phage GA hairpin, phage ΛN hairpin, iron response element (IRE), transactivation response element (TAR), U1A protein, or phage R-loop, which can facilitate the binding of gRNA comprising the corresponding ligands of the fusion partners to CasX.

In some cases, a CasX fusion partner utilized in the XDP systems has enzymatic activity that modifies a target nucleic acid (e.g., nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity). In some embodiments, a CasX variant comprises any one of the sequences of SEQ ID NOS: 135-457, 937-950, 1884-1929 and 35044-35047 as set forth in Tables 3 and 12 and a polypeptide with methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity.

In some cases, a CasX fusion partner utilized in the XDP systems has enzymatic activity that modifies a polypeptide associated with a target nucleic acid (e.g., a histone, an RNA binding protein, a DNA binding protein, and the like). Examples of enzymatic activity (that modifies a protein associated with a target nucleic acid) that can be provided by the fusion partner include but are not limited to: methyltransferase activity such as that provided by a histone methyltransferase (HMT) (e.g., suppressor of variegation 3-9 homolog 1 (SUV39H1, also known as KMT1A), euchromatic histone lysine methyltransferase 2 (G9A, also known as KMT1C and EHMT2), SUV39H2, ESET/SETDB 1, and the like, SET1A, SET1B, MLL1 to 5, ASH1, SYMD2, NSD1, DOT1L, Pr-SET7/8, SUV4-20H1, EZH2, RIZ1), demethylase activity such as that provided by a histone demethylase (e.g., Lysine Demethylase 1A (KDM1A also known as LSD1), JHDM2a/b, JMJD2A/JHDM3A, JMJD2B, JMJD2C/GASC1, JMJD2D, JARID1A/RBP2, JARID1B/PLU-1, JARID1C/SMCX, JARID1D/SMCY, UTX, JMJD3, and the like), acetyltransferase activity such as that provided by a histone acetylase transferase (e.g., catalytic core/fragment of the human acetyltransferase p300, GCN5, PCAF, CBP, TAF1, TIP60/PLIP, MOZ/MYST3, MORF/MYST4, HB01/MYST2, HMOF/MYST1, SRC1, ACTR, P160, CLOCK, and the like), deacetylase activity such as that provided by a histone deacetylase (e.g., HDAC1, HDAC2, HDAC3, HDAC8, HDAC4, HDAC5, HDAC7, HDAC9, SIRT1, SIRT2, HDAC11, and the like), kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, and demyristoylation activity.

Examples of proteins (or fragments thereof) that can be used as a CasX fusion partner utilized in the XDP systems to increase transcription include but are not limited to: transcriptional activators such as VP16, VP64, VP48, VP160, p65 subdomain (e.g., from NFkB), and activation domain of EDLL and/or TAL activation domain (e.g., for activity in plants); histone lysine methyltransferases such as SET1A, SET1B, MLL1 to 5, ASH1, SYMD2, NSD1, and the like; histone lysine demethylases such as JHDM2a/b, UTX, JMJD3, and the like; histone acetyltransferases such as GCN5, PCAF, CBP, p300, TAF1, TIP60/PLIP, MOZ/MYST3, MORF/MYST4, SRC1, ACTR, P160, CLOCK, and the like; and DNA demethylases such as Ten-Eleven Translocation (TET) dioxygenase 1 (TET1CD), TET1, DME, DML1, DML2, ROS1, and the like.

Examples of proteins (or fragments thereof) that can be used as a CasX fusion partner in an XDP to decrease transcription include but are not limited to: transcriptional repressors such as the Kruppel associated box (KRAB or SKD); KOX1 repression domain; the Mad mSIN3 interaction domain (SID); the ERF repressor domain (ERD), the SRDX repression domain (e.g., for repression in plants), and the like; histone lysine methyltransferases such as Pr-SET7/8, SUV4-20H1, RIZ1, and the like; histone lysine demethylases such as JMJD2A/JHDM3A, JMJD2B, JMJD2C/GASC1, JMJD2D, JARID1A/RBP2, JARID1B/PLU-1, JARID1C/SMCX, JARID1D/SMCY, and the like; histone lysine deacetylases such as HDAC1, HDAC2, HDAC3, HDAC8, HDAC4, HDAC5, HDAC7, HDAC9, SIRT1, SIRT2, HDAC11, and the like; DNA methylases such as HhaI DNA m5c-methyltransferase (M.HhaI), DNA methyltransferase 1 (DNMT1), DNA methyltransferase 3a (DNMT3a), DNA methyltransferase 3b (DNMT3b), DNMT3L, METI, DRM3 (plants), ZMET2, CMT1, CMT2 (plants), and the like; and periphery recruitment elements such as Lamin A, Lamin B, and the like.

In some cases, the CasX fusion partner utilized in the XDP systems has enzymatic activity that modifies the target nucleic acid (e.g., ssRNA, dsRNA, ssDNA, dsDNA). Examples of enzymatic activity that can be provided by the fusion partner include but are not limited to: nuclease activity such as that provided by a restriction enzyme (e.g., FokI nuclease), methyltransferase activity such as that provided by a methyltransferase (e.g., HhaI DNA m5c-methyltransferase (M.HhaI), DNA methyltransferase 1 (DNMT1), DNA methyltransferase 3a (DNMT3a), DNA methyltransferase 3b (DNMT3b), DNMT3L, METI, DRM3 (plants), ZMET2, CMT1, CMT2 (plants), and the like); demethylase activity such as that provided by a demethylase (e.g., Ten-Eleven Translocation (TET) dioxygenase 1 (TET 1 CD), TET1, DME, DML1, DML2, ROS1, and the like), DNA repair activity, DNA damage activity, deamination activity such as that provided by a deaminase (e.g., a cytosine deaminase enzyme, e.g., an APOBEC protein such as rat APOBEC1), an adenosine deaminase enzyme, dismutase activity, alkylation activity, depurination activity, oxidation activity, pyrimidine dimer forming activity, integrase activity such as that provided by an integrase and/or resolvase (e.g., Gin invertase such as the hyperactive mutant of the Gin invertase, GinH106Y; human immunodeficiency virus type 1 integrase (IN); Tn3 resolvase; and the like), transposase activity, recombinase activity such as that provided by a recombinase (e.g., catalytic domain of Gin recombinase), polymerase activity, ligase activity, helicase activity, photolyase activity, and glycosylase activity).

Suitable chloroplast transit peptides for use as fusion partners to the CasX variants of the XDP include, but are not limited to:

```
                                           (SEQ ID NO: 21)
MASMISSSAVTTVSRASRGQSAAMAPFGGLKSMTGFPVRKVNTDITSITS

NGGRVKCMQVWPPIGKKKFETLSYLPPLTRDSRA;

(SEQ ID NO: 22)
MASMISSSAVTTVSRASRGQSAAMAPFGGLKSMTGFPVRKVNTDITSITS

NGGRVKS;

(SEQ ID NO: 23)
MASSMLSSATMVASPAQATMVAPFNGLKSSAAFPATRKANNDITSITSNG

GRVNCMQVWPPIEKKKFETLSYLPDLTDSGGRVNC;

(SEQ ID NO: 24)
MAQVSRICNGVQNPSLISNLSKSSQRKSPLSVSLKTQQHPRAYPISSSWG

LKKSGMTLIGSELRPLKVMSSVSTAC;

(SEQ ID NO: 25)
MAQVSRICNGVWNPSLISNLSKSSQRKSPLSVSLKTQQHPRAYPISSSWG

LKKSGMTLIGSELRPLKVMSSVSTAC;

(SEQ ID NO: 26)
MAQINNMAQGIQTLNPNSNFHKPQVPKSSSFLVFGSKKLKNSANSMLVLK

KDSIFMQLFCSFRISASVATAC;

(SEQ ID NO: 27)
MAALVTSQLATSGTVLSVTDRFRRPGFQGLRPRNPADAALGMRTVGASAA

PKQSRKPHRFDRRCLSMVV;

(SEQ ID NO: 28)
MAALTTSQLATSATGFGIADRSAPSSLLRHGFQGLKPRSPAGGDATSLSV

TTSARATPKQQRSVQRGSRRFPSVVVC;

(SEQ ID NO: 29)
MASSVLSSAAVATRSNVAQANMVAPFTGLKSAASFPVSRKQNLDITSIAS

NGGRVQC;

(SEQ ID NO: 30)
MESLAATSVFAPSRVAVPAARALVRAGTVVPTRRTSSTSGTSGVKCSAAV

TPQASPVISRSAAAA;
and
                                           (SEQ ID NO: 31)
MGAAATSMQSLKFSNRLVPPSRRLSPVPNNVTCNNLPKSAAPVRTVKCCA

SSWNSTINGAAATTNGASAASS.
```

In some embodiments, a CasX variant utilized in the XDP systems of the disclosure comprises a sequence of any one of the sequences SEQ ID NOS: 135-457, 937-950, 1884-1929 or 35044-35047 of Tables 3 and 12 and an endosomal escape peptide or polypeptide to facilitate its transit out of an endosome of a host target cell. In some cases, an endosomal escape polypeptide comprises the amino acid sequence GLFXALLXLLXSLWXLLLXA (SEQ ID NO: 32), wherein each X is independently selected from lysine, histidine, and arginine. In some cases, an endosomal escape polypeptide comprises the amino acid sequence GLFHALLHLLHSLWHLLLHA (SEQ ID NO: 33), or HHHHHHHHH (SEQ ID NO: 34).

In some cases, a heterologous polypeptide (a fusion partner) provides for subcellular localization of the CasX to which it is fused, i.e., the heterologous polypeptide contains a subcellular localization sequence (e.g., a nuclear localization signal (NLS) for targeting to the nucleus, a sequence to keep the fusion protein out of the nucleus, e.g., a nuclear export signal (NES, for example any one of SEQ ID NOS: 35071-35120), a sequence to keep the fusion protein retained in the cytoplasm, a mitochondrial localization signal for targeting to the mitochondria, a chloroplast localization signal for targeting to a chloroplast, an ER retention signal, and the like). In some embodiments, a subject RNA-guided polypeptide does not include a NLS so that the protein is not targeted to the nucleus (which can be advantageous, e.g., when the target nucleic acid is an RNA that is present in the cytosol). In some embodiments, a fusion partner can provide a tag (i.e., the heterologous polypeptide is a detectable label) for ease of tracking and/or purification (e.g., a fluorescent protein, e.g., green fluorescent protein (GFP), yellow fluorescent protein (YFP), red fluorescent protein (RFP), cyan fluorescent protein (CFP), mCherry, tdTomato, and the like; a histidine tag, e.g., a 6×His tag; a hemagglutinin (HA) tag; a FLAG tag; a Myc tag; and the like).

In some embodiments, the CasX of the XDP system comprises one or more nuclear export signal (NES) sequences as a fusion partner to facilitate the export of the expressed CasX through the nuclear pore complex and into the cytoplasm, facilitating its incorporation into the budding XDP. By incorporation of the NES as a fusion partner, it can counteract the sequestering of the CasX protein that can result when the CasX protein also comprises one or more NLS. In some embodiments, the CasX of the XDP system comprises a sequence selected from the group consisting of SEQ ID NOS: 461-553 as set forth in Table 5. In some embodiments, the NES is linked to a C-terminal NLS by a cleavable linker capable of being cleaved by HIV protease; the same protease utilized to cleave the Gag polyprotein of the XDP. The XDP systems incorporating the NES are further described in the Examples.

In some cases, a CasX variant protein for use in the XDP systems includes (is fused to) a nuclear localization signal (NLS). In some cases, a CasX variant protein is fused to 2 or more, 3 or more, 4 or more, or 5 or more 6 or more, 7 or more, 8 or more NLSs. Non-limiting examples of NLSs suitable for use with a CRISPR protein, such as an CasX variant, in the XDP systems include sequences having at least about 80%, at least about 90%, or at least about 95% identity or are identical to sequences derived from: the NLS of the SV40 virus large T-antigen, having the amino acid sequence PKKKRKV (SEQ ID NO: 35); the NLS from nucleoplasmin (e.g., the nucleoplasmin bipartite NLS with the sequence KRPAATKKAGQAKKKK (SEQ ID NO: 36); the c-myc NLS having the amino acid sequence PAAKRVKLD (SEQ ID NO: 37) or RQRRNELKRSP (SEQ ID NO: 38); the hRNPA1 M9 NLS having the sequence NQSSNFGPMKGGNFGGRSSGPYGGGGQYFAKPRNQGGY (SEQ ID NO: 39); the sequence RMRIZFKNKGKDTAELRRRRVEVSVELRKAKKDEQILKRRNV (SEQ ID NO: 40) of the IBB domain from importin-alpha; the sequences VSRKRPRP (SEQ ID NO: 41) and PPKKARED (SEQ ID NO: 42) of the myoma T protein; the sequence PQPKKKPL (SEQ ID NO: 43) of human p53; the sequence SALIKKKKKMAP (SEQ ID NO: 44) of mouse c-abl IV; the sequences DRLRR (SEQ ID NO: 45) and PKQKKRK (SEQ ID NO: 46) of the influenza virus NS1; the sequence RKLKKKIKKL (SEQ ID NO: 47) of the Hepatitis virus delta antigen; the sequence REKKKFLKRR (SEQ ID NO: 48) of the mouse Mxl protein; the sequence KRKGDEVDGVDEVAKKKSKK (SEQ ID NO: 49) of the human poly(ADP-ribose) polymerase; the sequence RKCLQAGMNLEARKTKK (SEQ ID NO: 50) of the steroid hormone receptors (human) glucocorticoid; the sequence PRPRKIPR (SEQ ID NO: 51) of Borna disease virus P protein (BDV-P1); the sequence PPRKKRTVV (SEQ ID NO: 52) of hepatitis C virus nonstructural protein (HCV-NSSA); the sequence NLSKKKKRKREK (SEQ ID NO: 53) of LEF1; the sequence RRPSRPFRKP (SEQ ID NO: 54) of ORF57 simirae; the sequence KRPRSPSS (SEQ ID NO: 55) of EBV LANA; the sequence KRGINDRNFWRGENERKTR (SEQ ID NO: 56) of Influenza A protein; the sequence PRPPKMARYDN (SEQ ID NO: 57) of human RNA helicase A (RHA); the sequence KRSFSKAF of nucleolar RNA helicase II; the sequence KLKIKRPVK (SEQ ID NO: 58) of TUS-protein; the sequence PKKKRKVPPPPAAKRVKLD (SEQ ID NO: 59) associated with importin-alpha; the sequence PKTRRRPRRSQRKRPPT (SEQ ID NO: 60) from the Rex protein in HTLV-1; the sequence SRRRKANPTKLSENAKKLAKEVEN (SEQ ID NO: 61) from the EGL-13 protein of Caenorhabditis elegans; and the sequences KTRRRPRRSQRKRPPT (SEQ ID NO: 62), RRKKRRPRRKKRR (SEQ ID NO: 63), PKKKSRKPKKKSRK (SEQ ID NO: 64), HKKKHPDASVNFSEFSK (SEQ ID NO: 65), QRPGPYDRPQRPGPYDRP (SEQ ID NO: 66), LSPSLSPLLSPSLSPL (SEQ ID NO: 67), RGKGGKGLGKGGAKRHRK (SEQ ID NO: 68), PKRGRGRPKRGRGR (SEQ ID NO: 69), PKKKRKVPPPPAAKRVKLD (SEQ ID NO: 70), PKKKRKVPPPPKKKRKV (SEQ ID NO: 71), PAKRARRGYKC (SEQ ID NO: 72), KLGPRKATGRW (SEQ ID NO: 73), PRRKREE (SEQ ID NO: 74), PYRGRKE (SEQ ID NO: 75), PLRKRPRR (SEQ ID NO: 76), PLRKRPRRGSPLRKRPRR (SEQ ID NO: 77), PAAKRVKLDGGKRTADGSEFESPKKKRKV (SEQ ID NO: 78), PAAKRVKLDGGKRTADGSEFESPKKKRKVGIHGVPAA (SEQ ID NO: 79), PAAKRVKLDGGKRTADGSEFESPKKKRKVAEAAAKEAAAKEAAAKA (SEQ ID NO: 80), PAAKRVKLDGGKRTADGSEFESPKKKRKVPG (SEQ ID NO: 81), KRKGSPERGERKRHW (SEQ ID NO: 1858), KRTADSQHSTPPKTKRKVEFEPKKKRKV (SEQ ID NO: 82), and PKKKRKVGGSKRTADSQHSTPPKTKRKVEFEPKKKRKV (SEQ ID NO: 83). In some embodiments, the one or more NLS are linked to the CRISPR protein or to adjacent NLS with a linker peptide wherein the linker peptide is selected from the group consisting of SR, RS, (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO:

99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5. In general, NLS (or multiple NLSs) are of sufficient strength to drive accumulation of a CasX variant fusion protein in the nucleus of a eukaryotic cell. Detection of accumulation in the nucleus may be performed by any suitable technique. For example, a detectable marker may be fused to a CasX variant fusion protein such that location within a cell may be visualized. Cell nuclei may also be isolated from cells, the contents of which may then be analyzed by any suitable process for detecting protein, such as immunohistochemistry, Western blot, or enzyme activity assay. Accumulation in the nucleus may also be determined indirectly.

In some embodiments, a CasX variant protein for use in the XDP systems includes (is fused to) a nuclear localization signal (NLS) and a nuclear export signal (NES). In some embodiments, the CasX variant protein comprises a sequence of SEQ ID NOS: 135-457, 937-950, 1884-1929 or 35044-35047 as set forth in Tables 3 and 12, the NLS comprises a sequence selected form the group consisting of SEQ ID NOS: 35-83, 461-553 or 1858, and the NES comprises a sequence selected from the group consisting of SEQ ID NOS: 35071-35120.

The disclosure contemplates assembly of multiple NLS in various configurations for linkage to the CRISPR protein utilized in the XDP of the embodiments described herein. In some embodiments, 1, 2, 3, 4 or more NLS are linked by linker peptides at or near (e.g., within 50 amino acids of) the N-terminus of the CRISPR protein. In other embodiments, 1, 2, 3, 4 or more NLS are linked by linker peptides at or near (e.g., within 50 amino acids of) the C-terminus of the CRISPR protein. In some embodiments, the NLS linked to the N-terminus of the CRISPR protein are identical to the NLS linked to the C-terminus. In other embodiments, the NLS linked to the N-terminus of the CRISPR protein are different to the NLS linked to the C-terminus. In some embodiments, the NLS linked to the N-terminus of the CRISPR protein are selected from the group consisting of SEQ ID NOS: 461-507 as set forth in Table 5. In some embodiments, the NLS linked to the C-terminus of the CRISPR protein are selected from the group consisting of SEQ ID NOS: 508-553 as set forth in Table 5. Detection of accumulation in the nucleus of the CasX variant protein enhanced by the addition of NLS may be performed by any suitable technique; e.g., a detectable marker may be fused to a reference or CasX variant fusion protein such that location within a cell may be visualized by any suitable process for detecting protein, such as immunohistochemistry, Western blot, or enzyme activity assay. Accumulation in the nucleus may also be determined indirectly.

TABLE 5

NLS Sequences

| N-terminal Sequences | SEQ ID NO | C-terminal Sequences | SEQ ID NO |
|---|---|---|---|
| PKKKRKVGGSPKKKRKVSRQEIKRINKIRRRLVKDSNTKKAGKTGP | 461 | TLESPAAKRVKLDGGSPAAKRVKLDGGSPAAKRVKLDGGSPAAKRVKLDGGSPAAKRVKLDTLESKRPAATKKAGQAKKKKGGSKRPAATKKAGQAKKKKGGSKRPAATKKAGQAKKKKGGSKRPAATKKAGQAKKKK | 508 |
| PKKKRKVGGSPKKKRKVGGSPKKKRKVGSPKKKRKVSRQEIKRINKIRRRLVKDSNTKKAGKTGP | 462 | TLESKRPAATKKAGQAKKKKTLESKRPAATKKAGQAKKKKGGSKRPAATKKAGQAKKKKGGSKRPAATKKAGQAKKKKGGSKRPAATKKAGQAKKKKGGSKRPAATKKAGQAKKKK | 509 |
| PKKKRKVGGSPKKKRKVGGSPKKKRKVGSPKKKRKVGGSPKKKRKVGGSPKKKRKVSRQEIKRINKIRRRLVKDSNTKKAGKTGP | 463 | TLESKRPAATKKAGQAKKKKGGSKRPAATKKAGQAKKKKTLESPKKKRKVGGSPKKKRKVGGSPKKKRKVGGSPKKKRKV | 510 |
| PAAKRVKLDGGSPAAKRVKLDSRQEIKRINKIRRRLVKDSNTKKAGKTGP | 464 | TLEGGSPKKKRKVTLESPKKKRKVGGSPKKKRKVGGSPKKKRKVGGSPKKKRKV | 511 |
| PAAKRVKLDGGSPAAKRVKLDGGSPAAKRVKLDGGSPAAKRVKLDSRQEIKRINKIRRRLVKDSNTKKAGKTGP | 465 | TLEGGSPKKKRKVTLESPAAKRVKLDGGSPAAKRVKLDGGSPAAKRVKLDGGSPAAKRVKLD | 512 |
| PAAKRVKLDGGSPAAKRVKLDGGSPAAKRVKLDGGSPAAKRVKLDGGSPAAKRVKLDGGSPAAKRVKLDSRQEIKRINKIRRRLVKDSNTKKAGKTGP | 466 | TLEGGSPKKKRKVTLESPAAKRVKLDGGSPAAKRVKLDGGSPAAKRVKLDGGSPAAKRVKLDGGSPAAKRVKLD | 513 |
| KRPAATKKAGQAKKKKSRDISRQEIKRINKIRRRLVKDSNTKKAGKTGP | 467 | TLEGGSPKKKRKVTLESKRPAATKKAGQAKKKK | 514 |
| KRPAATKKAGQAKKKKSRQEIKRINKIRRLVKDSNTKKAGKTGP | 468 | TLEGGSPKKKRKVTLESKRPAATKKAGQAKKKKGGSKRPAATKKAGQAKKKK | 515 |
| KRPAATKKAGQAKKKKGGSKRPAATKKAGQAKKKKSRDISRQEIKRINKIRRRLVKDSNTKKAGKTGP | 469 | TLEGGSPKKKRKVTLEGGSPKKKRKV | 516 |
| KRPAATKKAGQAKKKKGGSKRPAATKKAGQAKKKKGGSKRPAATKKAGQAKKKKGG | 470 | TLEGGSPKKKRKVTLEGGSPKKKRKV | 517 |

TABLE 5-continued

NLS Sequences

| N-terminal Sequences | SEQ ID NO | C-terminal Sequences | SEQ ID NO |
|---|---|---|---|
| SKRPAATKKAGQAKKKKSRDISRQEIKRINKIRRRLVKDSNTKKAGKTGP | | | |
| KRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKSRDISRQEIKRINKIRRRLVKDSNTKKAGKTGP | 471 | TLEGGSPKKKRKVTLEGGSPKKKRKV | 518 |
| PKKKRKVGGSPKKKRKVGGSPKKKRKVGGSPKKKRKVSRDISRQEIKRINKIRRRLVKDSNTKKAGKTGP | 472 | TLEGGSPKKKRKVTLEGGSPKKKRKV | 519 |
| PKKKRKVGGSPKKKRKVGGSPKKKRKVGGSPKKKRKVSRDISRQEIKRINKIRRRLVKDSNTKKAGKTGP | 473 | TLEGGSPKKKRKVTLEGGSPKKKRKV | 520 |
| PAAKRVKLDGGSPAAKRVKLDGGSPAAKRVKLDGGSPAAKRVKLDSRDISRQEIKRINKIRRRLVKDSNTKKAGKTGP | 474 | TLEVGPKRTADSQHSTPPKTKRKVEFEPKKKRKVTLEGGSPKKKRKV | 521 |
| PAAKRVKLDGGSPAAKRVKLDGGSPAAKRVKLDGGSPAAKRVKLDGGSPAAKRVKLDSRDISRQEIKRINKIRRRLVKDSNTKKAGKTGP | 475 | TLEVGGGSGGGSKRTADSQHSTPPKTKRKVEFEPKKKRKVTLEGGSPKKKRKV | 522 |
| KRPAATKKAGQAKKKKSRDISRQEIKRINKIRRRLVKDSNTKKAGKTGP | 476 | TLEVAEAAAKEAAAKEAAAKAKRTADSQHSTPPKTKRKVEFEPKKKRKVTLEGGSPKKKRKV | 523 |
| KRPAATKKAGQAKKKKGGSKRPAATKKAGQAKKKKSRDISRQEIKRINKIRRRLVKDSNTKKAGKTGP | 477 | TLEVGPPKKKRKVGGSKRTADSQHSTPPKTKRKVEFEPKKKRKVTLEGGSPKKKRKV | 524 |
| PAAKRVKLDGGKRTADGSEFESPKKKRKVGGSSRDISRQEIKRINKIRRRLVKDSNTKKAGKTGP | 478 | TLEVGPAEAAAKEAAAKEAAAKAPAAKRVKLDTLEGGSPKKKRKV | 525 |
| PAAKRVKLDGGKRTADGSEFESPKKKRKVPPPPGSRDISRQEIKRINKIRRRLVKDSNTKKAGKTGP | 479 | TLEVGPGGGSGGGSGGGSPAAKRVKLDTLEVGPKRTADSQHSTPPKTKRKVEFEPKKKRKV | 526 |
| PAAKRVKLDGGKRTADGSEFESPKKKRKVGIHGVPAAPGSRDISRQEIKRINKIRRRLVKDSNTKKAGKTGP | 480 | TLEVGPPKKKRKVPPPPAAKRVKLDTLEVGGGSGGGSKRTADSQHSTPPKTKRKVEFEPKKKRKV | 527 |
| PAAKRVKLDGGKRTADGSEFESPKKKRKVGGGSGGGSPGSRDISRQEIKRINKIRRRLVKDSNTKKAGKTGP | 481 | TLEVGPPAAKRVKLDTLEVAEAAAKEAAAKEAAAKAKRTADSQHSTPPKTKRKVEFEPKKKRKV | 528 |
| PAAKRVKLDGGKRTADGSEFESPKKKRKVPGGGSGGGSPGSRDISRQEIKRINKIRRRLVKDSNTKKAGKTGP | 482 | TLEVGPKRTADSQHSTPPKTKRKVEFEPKKKRKVTLEVGPPKKKRKVGGSKRTADSQHSTPPKTKRKVEFEPKKKRKV | 529 |
| PAAKRVKLDGGKRTADGSEFESPKKKRKVAEAAAKEAAAKEAAAKAPGSRDISRQEIKRINKIRRRLVKDSNTKKAGKTGP | 483 | TLEVGGGSGGGSKRTADSQHSTPPKTKRKVEFEPKKKRKVTLEVGPAEAAAKEAAAKEAAAKAPAAKRVKLD | 530 |
| PAAKRVKLDGGKRTADGSEFESPKKKRKVPGSRDISRQEIKRINKIRRRLVKDSNTKKAGKTGP | 484 | GSKRPAATKKAGQAKKKKTLEVGPGGGSGGGSGGGSPAAKRVKLD | 531 |
| PAAKRVKLDGGSPKKKRKVGGSSRDISRQEIKRINKIRRRLVKDSNTKKAGKTGP | 485 | GSKRPAATKKAGQAKKKKTLEVGPPKKKRKVPPPPAAKRVKLD | 532 |
| PAAKRVKLDPPPPKKKRKVPGSRDISRQEIKRINKIRRRLVKDSNTKKAGKTGP | 486 | GSKRPAATKKAGQAKKKKTLEVGPPAAKRVKLD | 533 |
| PAAKRVKLDPGRSDISRQEIKRINKIRRRLVKDSNTKKAGKTGP | 487 | GSPKKKRKVTLEVGPKRTADSQHSTPPKTKRKVEFEPKKKRKV | 534 |
| PKKKRKVSRDISRQEIKRINKIRRRLVKDSNTKKAGKTGP | 488 | GSKRPAATKKAGQAKKKKTLEVGGGSGGGSKRTADSQHSTPPKTKRKVEFEPKKKRKV | 535 |

TABLE 5-continued

NLS Sequences

| N-terminal Sequences | SEQ ID NO | C-terminal Sequences | SEQ ID NO |
|---|---|---|---|
| PAAKRVKLDGGKRTADGSEFESPKKKRKVGGSSRDISRQEIKRINKIRRRLVKDSNTKKAGKTGP | 489 | GSKRPAATKKAGQAKKKKGSKRPAATKKAGQAKKKK | 536 |
| PAAKRVKLDGGKRTADGSEFESPKKKRKVGGGSGGGSPGSRDISRQEIKRINKIRRRLVKDSNTKKAGKTGP | 490 | GSKRPAATKKAGQAKKKKGSKRPAATKKAGQAKKKK | 537 |
| PKKKRKVSRQEIKRINKIRRRLVKDSNTKKKAGKTGP | 491 | GSKRPAATKKAGQAKKKKGSKRPAATKKAGQAKKKK | 538 |
| PKKKRKVGGSPKKKRKVGGSPKKKRKVGGSPKKKRKVSRQEIKRINKIRRRLVKDSNTKKAGKTGP | 492 | GSPKKKRKVGGSPKKKRKV | 539 |
| PKKKRKVGGSPKKKRKVGGSPKKKRKVGGSPKKKRKVGGSPKKKRKVGGSPKKKRKVSRQEIKRINKIRRRLVKDSNTKKAGKTGP | 493 | GGGSGGGSKRTADSQHSTPPKTKRKVEFEPKKKRKVGSKRPAATKKAGQAKKKK | 540 |
| PAAKRVKLDSRQEIKRINKIRRRLVKDSNTKKAGKTGP | 494 | GPPKKKRKVGGSKRTADSQHSTPPKTKRKVEFEPKKKRKVGSKRPAATKKAGQAKKKK | 541 |
| PAAKRVKLDGGSPAAKRVKLDSRQEIKRINKIRRRLVKDSNTKKAGKTGP | 495 | TGGGPGGGAAAGSGSPKKKRKVGSGSGSKRPAATKKAGQAKKKK | 542 |
| PAAKRVKLDGGSPAAKRVKLDGGSPAAKRVKLDGGSPAAKRVKLDSRQEIKRINKIRRRLVKDSNTKKAGKTGP | 496 | GPKRTADSQHSTPPKTKRKVEFEPKKKRKVGSKRPAATKKAGQAKKKK | 543 |
| PAAKRVKLDGGSPAAKRVKLDGGSPAAKRVKLDGGSPAAKRVKLDGGSPAAKRVKLDSRQEIKRINKIRRRLVKDSNTKKAGKTGP | 497 | AEAAAKEAAAKEAAAKAKRTADSQHSTPPKTKRKVEFEPKKKRKVGSPKKKRKV | 544 |
| KRPAATKKAGQAKKKKSRQEIKRINKIRRRLVKDSNTKKAGKTGP | 498 | GPPKKKRKVPPPPAAKRVKLDGGGSGGGSKRTADSQHSTPPKTKRKVEFEPKKKRKV | 545 |
| TSPKKKRKVALEYPYDVPDYA | 499 | GSPAAKRVKLDGGSPAAKRVKLDGGSPAAKRVKLDGGSPAAKRVKLDGGSPAAKRVKLDGGSPAAKRVKLDGPPKKKRKVGSKRTADSQHSTPPKTKRKVEFEPKKKRKV | 546 |
| TLESKRPAATKKAGQAKKKKAPGEYPYDVPDYA | 500 | GSPAAKRVKLGGSPAAKRVKLGGSPKKKRKVGGSPKKKRKVTGGGPGGGAAAGSGSPKKKRKVGSGS | 547 |
| GSKRPAATKKAGQAKKKKYPYDVPDYA | 501 | GSKRPAATKKAGQAKKKKGGSKRPAATKKAGQAKKKKGPKRTADSQHSTPPKTKRKVEFEPKKKRKV | 548 |
| TLESKRPAATKKAGQAKKKKGGSKRPAATKKAGQAKKKKAPGEYPYDVPDYATSPKKKRKVALEYPYDVPDYA | 502 | GSKRPAATKKAGQAKKKKGGSKRPAATKKAGQAKKKKAEAAAKEAAAKEAAAKAKRTADSQHSTPPKTKRKVEFEPKKKRKV | 549 |
| TLESKRPAATKKAGQAKKKKGGSKRPAATKKAGQAKKKKGGSKRPAATKKAGQAKKKKGGSKRPAATKKAGQAKKKKTSPKKKRKVALEYPYDVPDYA | 503 | GPPKKKRKVPPPPAAKRVKLD | 550 |
| TLESKRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKKTSPKKKRKVALEYPYDVPDYA | 504 | GSPAAKRVKLDGGSPAAKRVKLDGGSPAAKRVKLDGGSPAAKRVKLDGGSPAAKRVKLD | 551 |
| TLESPKKKRKVGGSPKKKRKVGGSPKKKRKVGGSPKKKRKVTLESKRPAATKKAGQAKKKKAPGEYPYDVPDYA | 505 | GSPAAKRVKLGGSPAAKRVKLGGSPKKKRKVGGSPKKKRKV | 552 |

TABLE 5-continued

NLS Sequences

| N-terminal Sequences | SEQ ID NO | C-terminal Sequences | SEQ ID NO |
|---|---|---|---|
| TLESPKKKRKVGGSPKKKRKVGGSPKKK RKVGGSPKKKRKVGSKRPAATKKAGQAK KKKYPYDVPDYA | 506 | GSKRPAATKKAGQAKKKKGGSKRPAAT KKAGQAKKKK | 553 |
| TLESPAAKRVKLDGGSPAAKRVKLDGGS PAAKRVKLDGGSPAAKRVKLDTLESKRP AATKKAGQAKKKKGGSKRPAATKKAGQA KKKKAPGEYPYDVPDYA | 507 | GSKRPAATKKAGQAKKKKGGSKRPAAT KKAGQAKKKK | 553 |

In some cases, a CasX variant fusion protein includes a "Protein Transduction Domain" or PTD (also known as a CPP—cell penetrating peptide), which refers to a protein, polynucleotide, carbohydrate, or organic or inorganic compound that facilitates traversing a lipid bilayer, micelle, cell membrane, organelle membrane, or vesicle membrane. A PTD attached to another molecule, which can range from a small polar molecule to a large macromolecule and/or a nanoparticle, facilitates the molecule traversing a membrane, for example going from an extracellular space to an intracellular space, or from the cytosol to within an organelle. In some embodiments, a PTD is covalently linked to the amino terminus of a reference or CasX variant fusion protein. In some embodiments, a PTD is covalently linked to the carboxyl terminus of a CasX variant fusion protein. In some cases, the PTD is inserted internally in the sequence of a CasX variant fusion protein at a suitable insertion site. In some cases, a CasX variant fusion protein includes (is conjugated to, is fused to) one or more PTDs (e.g., two or more, three or more, four or more PTDs). In some cases, a PTD includes one or more nuclear localization signals (NLS). Examples of PTDs include but are not limited to peptide transduction domain of HIV TAT comprising YGRKKRRQRRR (SEQ ID NO: 555), RKKRRQRR (SEQ ID NO: 556); YARAAARQARA (SEQ ID NO: 557); THRLPRRRRRR (SEQ ID NO: 558); and GGR-RARRRRRR (SEQ ID NO: 559); a polyarginine sequence comprising a number of arginines sufficient to direct entry into a cell (e.g., 3, 4, 5, 6, 7, 8, 9, 10, or 10-50 arginines, SEQ ID NO: 559); a VP22 domain (Zender et al. (2002) Cancer Gene Ther. 9(6):489-96); a *Drosophila* Antennapedia protein transduction domain (Noguchi et al. (2003) Diabetes 52(7): 1732-1737); a truncated human calcitonin peptide (Trehin et al. (2004) Pharm. Research 21:1248-1256); polylysine (Wender et al. (2000) Proc. Natl. Acad. Sci. USA 97: 13003-13008); RRQRRTSKLMKR (SEQ ID NO: 560); Transportan GWTLNSAGYLLGKINLKALAALAKKIL (SEQ ID NO: 561); KALAWEAKLAKALAKA-LAKHLAKALAKALKCEA (SEQ ID NO: 562); and RQIKIWFQNRRMKWKK (SEQ ID NO: 563). In some embodiments, the PTD is an activatable CPP (ACPP) (Aguilera et al. (2009) Integr Biol (Camb) June; 1(5-6): 371-381). ACPPs comprise a polycationic CPP (e.g., Arg9 or "R9") connected via a cleavable linker to a matching polyanion (e.g., Glu9 or "E9"), which reduces the net charge to nearly zero and thereby inhibits adhesion and uptake into cells. Upon cleavage of the linker, the polyanion is released, locally unmasking the polyarginine and its inherent adhesiveness, thus "activating" the ACPP to traverse the membrane. In some embodiments, a CasX variant comprises a sequence of any one of SEQ ID NOS: 135-457, 937-950, 1884-1929 or 35044-35047 of Table 3 or Table 12 and a PTD.

In some embodiments, a reference or CasX variant fusion protein can be linked at the C-terminal and/or N-terminal end to a heterologous polypeptide (fusion partner) via a linker polypeptide (e.g., one or more linker polypeptides). The linker polypeptide may have any of a variety of amino acid sequences. Proteins can be joined by a spacer peptide, generally of a flexible nature, although other chemical linkages are not excluded. Suitable linkers include polypeptides of between 4 amino acids and 40 amino acids in length, or between 4 amino acids and 25 amino acids in length. The use of small amino acids, such as glycine, serine, proline and alanine, are of use in creating a flexible peptide. The creation of such sequences is routine to those of skill in the art. A variety of different linkers are commercially available and are considered suitable for use. Example linker polypeptides include glycine polymers (G)n (SEQ ID NO: 84), glycine-serine polymer (including, for example, (GS)n (SEQ ID NO: 85), (GSGGS)n (SEQ ID NO: 86), (GGSGGS)n (SEQ ID NO: 87), and (GGGS)n (SEQ ID NO: 88), where n is an integer of at least one), glycine-alanine polymers, alanine-serine polymers, glycine-proline polymers, proline polymers and proline-alanine polymers. Example linkers can comprise amino acid sequences including, but not limited to SR, RS, (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO:99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5. The ordinarily skilled artisan will recognize that design of a peptide conjugated to any elements described above can include linkers that are all or partially flexible, such that the linker can include a flexible linker as well as one or more portions that confer less flexible structure.

h. Catalytically-Dead CasX Variants

The present disclosure provides catalytically-dead CasX variants (interchangeably referred to herein as "dCasX" or "dCasX variant") for use in the XDP systems, wherein the catalytically-dead CasX variants comprise at least one modification in at least one domain relative to the catalytically-dead versions of sequences of SEQ ID NOS: 1-3 (described, supra). An exemplary catalytically dead CasX protein comprises one or more mutations in the active site of the RuvC domain of the CasX protein. In some embodiments, a catalytically dead reference CasX protein comprises substitutions at residues 672, 769 and/or 935 with reference to SEQ ID NO: 1. In one embodiment, a catalytically-dead reference CasX protein comprises substitutions of D672A, E769A and/or D935A with reference to SEQ ID NO: 1. In other embodiments, a catalytically-dead reference CasX protein comprises substitutions at amino acids 659, 756 and/or 922 with reference to SEQ ID NO: 2. In some embodiments, a catalytically-dead reference CasX protein comprises D659A, E756A and/or D922A substitutions with reference to of SEQ ID NO: 2. An exemplary RuvC domain comprises amino acids 661-824 and 935-986 of SEQ ID NO: 1, or amino acids 648-812 and 922-978 of SEQ ID NO: 2. It will be understood that the same foregoing substitutions or deletions can similarly be introduced into any of the CasX variants of the disclosure, relative to the corresponding positions (allowing for any insertions or deletions) of the starting variant, resulting in a dCasX variant.

In some embodiments, a dCasX variant protein utilized in the gene repressor XDP systems of the disclosure comprises a sequence of SEQ ID NOS: 1939-1958 as set forth in Table 6. In some embodiments, a dCasX variant protein consists of a sequence of SEQ ID NOS: 1939-1958 as set forth in Table 6. In other embodiments, a dCasX variant protein comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical to a sequence of SEQ ID NOS: 1939-1958 as set forth in Table 6, and retains the ability to form an RNP with a gRNA. In a particular embodiment, the dCasX variant protein consists of a sequence of SEQ ID NO: 1940.

In some embodiments, the dCasX of the disclosure and linked repressor domains described herein ("dCasX-repressor" or "dXR") are utilized with the gRNA of any of the embodiments described herein, wherein the dCasX-repressor and gRNA are able to form a ribonucleoprotein (RNP) complex and bind to the target nucleic acid to effect the repression of transcription of the gene.

TABLE 6

| dCasX Variant Sequences | |
|---|---|
| SEQ ID NO | dCasX |
| 1939 | CAS100 |
| 1940 | CAS099 |
| 1941 | CAS098 |
| 1942 | CAS085 |
| 1943 | CAS087 |
| 1944 | CAS086 |
| 1945 | CAS083 |
| 1946 | CAS082 |
| 1947 | CAS069 |
| 1948 | CAS068 |
| 1949 | CAS070 |
| 1950 | CAS071 |
| 1951 | CAS072 |
| 1952 | CAS073 |
| 1953 | CAS074 |
| 1954 | CAS075 |
| 1955 | CAS076 |

TABLE 6-continued

| dCasX Variant Sequences | |
|---|---|
| SEQ ID NO | dCasX |
| 1956 | CAS077 |
| 1957 | CAS078 |
| 1958 | CAS081 | i. Repressor Domain Fusion Proteins

In some embodiments, the disclosure provides catalytically-dead CasX variant proteins linked to one or more repressor domains for use in the XDP systems, and one or more guide ribonucleic acids (gRNA) comprising a targeting sequence complementary to a target nucleic acid sequence, wherein the system is capable of binding to a target nucleic acid of a gene and repressing transcription of the gene product.

In the context of the present disclosure and with respect to a gene, "repression", "repressing", "inhibition of gene expression", "downregulation", and "silencing" are used interchangeably herein to refer to the inhibition or blocking of transcription of a gene or a portion thereof. Accordingly, repression of a gene can result in a decrease in production of a gene product. Examples of gene repression processes which decrease transcription include, but are not limited to, those which inhibit formation of a transcription initiation complex, those which decrease transcription initiation rate, those which decrease transcription elongation rate, those which decrease processivity of transcription and those which antagonize transcriptional activation (by, for example, blocking the binding of a transcriptional activator). Gene repression can constitute, for example, prevention of activation as well as inhibition of expression below an existing level. Transcriptional repression includes both reversible and irreversible inactivation of gene transcription. In some embodiments, repression by the systems of the disclosure comprises any detectable decrease in the production of a gene product in cells, preferably a decrease in production of the gene product by at least about 10%, 20%, 30%, 40%, 50%, 60%, 70%, 80%, 90%, 95%, or 99%, or any integer there between, when compared to untreated cells or cells treated with a comparable system comprising a non-targeting spacer. Most preferably, gene repression results in complete inhibition of gene expression, such that no gene product is detectable. In some embodiments, the repression of transcription by the systems of the embodiments is sustained for at least about 8 hours, at least about 1 day, at least about 1 week, at least about 1 month, or at least about 3 months, or at least about 6 months when assessed in an in vitro assay, including cell-based assays. In some embodiments, the repression of transcription by the gene repressor systems of the embodiments is sustained for at least about 1 day, at least about 1 week, at least about 1 month, or at least about 3 months, or at least about 6 months when assessed in a subject that has been administered a therapeutically-effective dose of a system of the embodiments described herein. In some embodiments, gene repression by the system results in no or minimal detectable off-target binding or off-target activity, when assessed in an in vitro assay. In other embodiments, gene repression by the system results in no or minimal detectable off-target binding or off-target activity, when assessed in a subject that has been administered a therapeutically-effective dose of a system of the embodiments described herein.

In some embodiments, the present disclosure provides systems of catalytically-dead CasX (dCasX) proteins linked to one or more repressor domains as a fusion protein (dXR) and one or more guide ribonucleic acids (gRNA) for use in repressing a target nucleic acid, inclusive of coding and non-coding regions. In the RNP, the dCasX protein and linked repressor domain(s) of the pre-complexed dXR: gRNA provides the site-specific activity and is guided to a target site (and further stabilized at a target site) within a target nucleic acid sequence to be repressed by virtue of its association with the gRNA. In some embodiments, the gene target nucleic acid sequence complementary to the targeting sequence of the gRNA is within 1 kb of a transcription start site (TSS) in the targeted gene. In some embodiments, the gene target nucleic acid sequence target nucleic acid sequence complementary to the targeting sequence of the gRNA is within 500 bps upstream to 500 bps downstream of a TSS of the gene. In some embodiments, the gene target nucleic acid sequence target nucleic acid sequence complementary to the targeting sequence of the gRNA is within 300 bps upstream to 300 bps downstream of a TSS of the gene. In some embodiments, the gene target nucleic acid sequence target nucleic acid sequence complementary to the targeting sequence of the gRNA is within 1 kb of an enhancer of the gene. In some embodiments, the gene target nucleic acid sequence target nucleic acid sequence complementary to the targeting sequence of the gRNA is within the 3' untranslated region of the gene. In some embodiments, the gene target nucleic acid sequence target nucleic acid sequence complementary to the targeting sequence of the gRNA is within an exon of the gene. In some embodiments, the gene target nucleic acid sequence target nucleic acid sequence complementary to the targeting sequence of the gRNA is within exon 1 of the gene.

Amongst repressor domains that have the ability to repress, or silence genes, the Kruppel-associated box (KRAB) repressor domain is amongst the most powerful in human genome systems (Alerasool, N., et al. An efficient KRAB domain for CRISPRi applications. Nat. Methods 17:1093 (2020)). KRAB domains are present in approximately 400 human zinc finger protein-based transcription factors, and induce repression by interacting with factors such as TRIM28/KAP1, a scaffold protein that assembles a protein complex with chromatin regulators such as CBX5/HP1α and SETDB1. Human genes encoding KRAB zinc-finger proteins include KOX1/ZNF10, KOX8/ZNF708, ZNF43, ZNF184, ZNF91, HPF4, HTF10, HTF34, and the sequences of SEQ ID NOS: 2381-2914. In some embodiments, the KRAB transcriptional repressor domain of the systems is selected from the group consisting of (in all cases, ZNF=zinc finger protein; KRBOX=KRAB box domain containing; ZKSCAN=zinc finger with KRAB and SCAN domains; SSX=SSX family member; KRBA=KRAB-A domain containing; ZFP=zinc finger protein) ZNF343, ZNF10, ZNF337, ZNF334, ZNF215, ZNF519, ZNF485, ZNF214, ZNF33B, ZNF287, ZNF705A, ZNF37A, KRBOX4, ZKSCAN3, ZKSCAN4, ZNF57, ZNF557, ZNF705B, ZNF662, ZNF77, ZNF500, ZNF558, ZNF620, ZNF713, ZNF823, ZNF440, ZNF441, ZNF136, small nuclear ribonucleoprotein polypeptides B and B1 (SNRPB), ZNF735, ZKSCAN2, ZNF619, ZNF627, ZNF333, ATP binding cassette subfamily A member 11 (ABCA11P), PLD5 pseudogene 1 (PLD5P1), ZNF25, ZNF727, ZNF595, ZNF14, ZNF33A, ZNF101, ZNF253, ZNF56, ZNF720, ZNF85, ZNF66, ZNF722P, ZNF486, ZNF682, ZNF626, ZNF100, ZNF93, ZKSCAN1, ZNF257, ZNF729, ZNF208, ZNF90, ZNF430, ZNF676, ZNF91, ZNF429, ZNF675, ZNF681, ZNF99, ZNF431, ZNF98, ZNF708, ZNF732, SSX family member 2 (SSX2), ZNF721, ZNF726, ZNF730, ZNF506, ZNF728, ZNF141, ZNF723, ZNF302, ZNF484, SSX2B, ZNF718, ZNF74, ZNF157, ZNF790, ZNF565, ZNF705G, vomeronasal 1 receptor 107 pseudogene (VN1R107P), solute carrier family 27 member 5 (SLC27A5), ZNF737, SSX4, ZNF850, ZNF717, ZNF155, ZNF283, ZNF404, ZNF114, ZNF716, ZNF230, ZNF45, ZNF222, ZNF286A, ZNF624, ZNF223, ZNF284, ZNF790-AS1, ZNF382, ZNF749, ZNF615, ZFP90, ZNF225, ZNF234, ZNF568, ZNF614, ZNF584, ZNF432, ZNF461, ZNF182, ZNF630, ZNF630-AS1, ZNF132, ZNF420, ZNF324B, ZNF616, ZNF471, ZNF227, ZNF324, ZNF860, ZFP28 zinc finger protein (ZFP28), ZNF470, ZNF586, ZNF235, ZNF274, ZNF446, ZFP1, ZIM3, ZNF212, ZNF766, ZNF264, ZNF480, ZNF667, ZNF805, ZNF610, ZNF783, ZNF621, ZNF8-DT, ZNF880, ZNF213-AS1, ZNF213, ZNF263, zinc finger and SCAN domain containing 32 (ZSCAN32), ZIM2, ZNF597, ZNF786, KRAB-A domain containing 1 (KRBA1), ZNF460, ZNF8, ZNF875, ZNF543, ZNF133, ZNF229, ZNF528, SSX1, ZNF81, ZNF578, ZNF862, ZNF777, ZNF425, ZNF548, ZNF746, ZNF282, ZNF398, ZNF599, ZNF251, ZNF195, ZNF181, RBAK-RBAKDN readthrough (RBAK-RBAKDN), ZFP37, RNA, 7SL, cytoplasmic 526, pseudogene (RN7SL526P), ZNF879, ZNF26, ZSCAN21, ZNF3, ZNF354C, ZNF10, ZNF75D, ZNF426, ZNF561, ZNF562, ZNF846, ZNF782, ZNF552, ZNF587B, ZNF814, ZNF587, ZNF92, ZNF417, ZNF256, ZNF473, ZFP14, ZFP82, ZNF529, ZNF605, ZFP57, ZNF724, ZNF43, ZNF354A, ZNF547, SSX4B, ZNF585A, ZNF585B, ZNF792, ZNF789, ZNF394, ZNF655, ZFP92, ZNF41, ZNF674, ZNF546, ZNF780B, ZNF699, ZNF177, ZNF560, ZNF583, ZNF707, ZNF808, ZKSCAN5, ZNF137P, ZNF611, ZNF600, ZNF28, ZNF773, ZNF549, ZNF550, ZNF416, ZIK1, ZNF211, ZNF527, ZNF569, ZNF793, ZNF571-AS1, ZNF540, ZNF571, ZNF607, ZNF75A, ZNF205, ZNF175, ZNF268, ZNF354B, ZNF135, ZNF221, ZNF285, ZNF419, ZNF30, ZNF304, ZNF254, ZNF701, ZNF418, ZNF71, ZNF570, ZNF705E, KRBOX1, ZNF510, ZNF778, PR/SET domain 9 (PRDM9), ZNF248, ZNF845, ZNF525, ZNF765, ZNF813, ZNF747, ZNF764, ZNF785, ZNF689, ZNF311, ZNF169, ZNF483, ZNF493, ZNF189, ZNF658, ZNF564, ZNF490, ZNF791, ZNF678, ZNF454, ZNF34, ZNF7, ZNF250, ZNF705D, ZNF641, ZNF2, ZNF554, ZNF555, ZNF556, ZNF596, ZNF517, ZNF331, ZNF18, ZNF829, ZNF772, ZNF17, ZNF112, ZNF514, ZNF688, PRDM7, ZNF695, ZNF670-ZNF695, ZNF138, ZNF670, ZNF19, ZNF316, ZNF12, ZNF202, RBAK, ZNF83, ZNF468, ZNF479, ZNF679, ZNF736, ZNF680, ZNF273, ZNF107, ZNF267, ZKSCAN8, ZNF84, ZNF573, ZNF23, ZNF559, ZNF44, ZNF563, ZNF442, ZNF799, ZNF443, ZNF709, ZNF566, ZNF69, ZNF700, ZNF763, ZNF433-AS1, ZNF433, ZNF878, ZNF844, ZNF788P, ZNF20, ZNF625-ZNF20, ZNF625, ZNF606, ZNF530, ZNF577, ZNF649, ZNF613, ZNF350, ZNF317, ZNF300, ZNF180, ZNF415, vomeronasal 1 receptor 1 (VN1R1), ZNF266, ZNF738, ZNF445, ZNF852, ZKSCAN7, ZNF660, myosin phosphatase Rho interacting protein pseudogene 1 (MPRIPP1), ZNF197, ZNF567, ZNF582, ZNF439, ZFP30, ZNF559-ZNF177, ZNF226, ZNF841, ZNF544, ZNF233, ZNF534, ZNF836, ZNF320, KRBA2, ZNF761, ZNF383, ZNF224, ZNF551, ZNF154, ZNF671, ZNF776, ZNF780A, ZNF888, ZNF816-ZNF321P, ZNF321P, ZNF816, ZNF347, ZNF665, ZNF677, ZNF160, ZNF184, ZNF140, ZNF589, ZNF891, ZFP69B, ZNF436, pogo transposable element derived with KRAB domain (POGK), ZNF669, ZFP69, ZNF684, ZNF124, and ZNF496, or sequence variants having at least about 65%, at least about 75%, at least about 85%, at least about 90% at least about 91%, at least about 92%, at least about 93% at least about 94% at least about 95%, at least about 96%, at least about 97%, at least about 98%, or at least about 99% identity thereto.

In some embodiments, the system comprises a single KRAB domain operably linked to the catalytically-dead Class 2, Type V CRISPR protein as a fusion protein, wherein the catalytically-dead Class 2, Type V CRISPR protein is a dCasX selected from the group of sequences of SEQ ID NOS: 1939-1958 as set forth in Table 6, or a sequence variant having at least about 65%, at least about 75%, at least about 85%, at least about 90% at least about 91%, at least about 92%, at least about 93% at least about 94% at least about 95%, at least about 96%, at least about 97%, at least about 98%, or at least about 99% identity thereto, and wherein the KRAB domain is selected from the group of sequences consisting of SEQ ID NOS: 2915-35034, or a sequence having at least about 65%, at least about 75%, at least about 85%, at least about 90% at least about 91%, at least about 92%, at least about 93% at least about 94% at least about 95%, at least about 96%, at least about 97%, at least about 98%, or at least about 99% identity thereto. In some embodiments, the KRAB repressor domain is linked at or near the C-terminus of the dCasX by a linker peptide sequence. In other embodiments, the KRAB repressor domain is linked at or near the N-terminus of the dCasX by a linker peptide sequence, including any of the linker embodiments described herein.

IV. GUIDE NUCLEIC ACIDS OF XDP SYSTEMS

In another aspect, the disclosure relates to XDP system components that encode or incorporate CRISPR Class 2 guide ribonucleic acids (gRNA) wherein the gRNA variant comprises a targeting sequence engineered to be complementary to a target nucleic acid sequence of a gene that have utility, when complexed with a CRISPR nuclease, in genome editing or modification of the target nucleic acid in a cell. In certain embodiments, the Class 2 system utilized in the XDP can be a Type II, Type V, or Type VI system. It is envisioned that in some embodiments, multiple gRNA variants are delivered in the systems for the modification of a target nucleic acid. For example, a pair of gRNA variants with targeting sequences to different or overlapping regions of the target nucleic acid sequence can be used, when each is complexed with a CRISPR nuclease as an RNP, in order to bind and cleave at two different or overlapping sites within the gene, which is then edited by non-homologous end joining (NHEJ), homology-directed repair (HDR), homology-independent targeted integration (HITI), microhomology mediated end joining (MMEJ), single strand annealing (SSA) or base excision repair (BER). In some cases, the XDP encapsidates two different RNPs, wherein the CRISPR nuclease and guide scaffolds are be identical but the targeting sequence of the second guide is complementary to a different region of the target nucleic acid, or even to a different locus in cases where a bispecific system is contemplated. In other cases, the XDP encapsidates two different RNPs, wherein the CRISPR nuclease is identical and the second guide scaffold is different from the first guide scaffold, and the targeting sequence of the second guide is complementary to a different region of the target nucleic acid, or even to a different locus in cases where a bispecific system is contemplated. XDP systems comprising two different RNPs are provided in the examples, below.

In some embodiments, the disclosure provides gRNA variants utilized in the XDP systems that have utility in genome editing or modification of a gene in a eukaryotic cell. In a particular embodiment, the gRNA variants of the XDP systems are capable of forming a complex with a CasX variant nuclease; a ribonucleoprotein (RNP) complex, described more fully, below.

a. Reference gRNA and gRNA Variants

As used herein, a "reference gRNA" refers to a CRISPR guide nucleic acid comprising a wild-type sequence of a naturally-occurring gRNA. In some embodiments, a reference gRNA of the disclosure may be subjected to one or more mutagenesis methods, such as the mutagenesis methods described herein (as well as in PCT/US20/36506 and WO2020247883A2, incorporated by reference herein), which may include Deep Mutational Evolution (DME), deep mutational scanning (DMS), error prone PCR, cassette mutagenesis, random mutagenesis, staggered extension PCR, gene shuffling, or domain swapping, in order to generate one or more guide nucleic acid variants (referred to herein as "gRNA variant") with enhanced or varied properties relative to the reference gRNA. gRNA variants also include variants comprising one or more exogenous sequences, for example fused to either the 5' or 3' end, or inserted internally. The activity of reference gRNAs may be used as a benchmark against which the activity of gRNA variants are compared, thereby measuring improvements in function or other characteristics of the gRNA variants. In other embodiments, a reference gRNA may be subjected to one or more deliberate, specifically-targeted mutations in order to produce a gRNA variant, for example a rationally designed variant with enhanced or varied properties relative to the parent gRNA variant from which it was derived. Exemplary characteristics of such improvements, and assay methods to assess them, are provided herein.

The gRNAs of the XDP systems of the disclosure comprise two segments: a targeting sequence and a protein-binding segment. The targeting segment of a gRNA includes a nucleotide sequence (referred to interchangeably as a guide sequence, a spacer, a targeter, or a targeting sequence) that is complementary to (and therefore hybridizes with) a specific sequence (a target site) within the target nucleic acid sequence (e.g., a target ssRNA, a target ssDNA, a strand of a double stranded target DNA, etc.), described more fully below. The targeting sequence of a gRNA is capable of binding to a target nucleic acid sequence, including a coding sequence, a complement of a coding sequence, a non-coding sequence, and to accessory elements. The protein-binding segment (or "activator" or "protein-binding sequence") interacts with (e.g., binds to) a CasX protein as a complex, forming an RNP (described more fully, below). The protein-binding segment is alternatively referred to herein as a "scaffold", which is comprised of several regions, described more fully, below.

In the case of a dual guide RNA (dgRNA), the targeter and the activator portions each have a duplex-forming segment, where the duplex forming segment of the targeter and the duplex-forming segment of the activator have complementarity with one another and hybridize to one another to form a double stranded duplex (dsRNA duplex for a gRNA). When the gRNA is a gRNA, the term "targeter" or "targeter RNA" is used herein to refer to a crRNA-like molecule (crRNA: "CRISPR RNA") of a CasX dual guide RNA (and therefore of a CasX single guide RNA when the "activator" and the "targeter" are linked together; e.g., by intervening nucleotides). The crRNA has a 5' region that anneals with the tracrRNA followed by the nucleotides of the targeting sequence. Thus, for example, a guide RNA (dgRNA or sgRNA) comprises a guide sequence and a duplex-forming segment of a crRNA, which can also be referred to as a crRNA repeat. A corresponding tracrRNA-like molecule (activator) also comprises a duplex-forming stretch of nucleotides that forms the other half of the dsRNA duplex of the protein-binding segment of the guide RNA. Thus, a targeter and an activator, as a corresponding pair, hybridize to form a dual guide RNA, a "dual-molecule gRNA", a "dgRNA", a "double-molecule guide RNA", or a "two-molecule guide RNA". In other embodiments, the activator and targeter of the gRNA are covalently linked to one another (rather than hybridizing to one another) and comprise a single molecule, referred to herein as a "single-molecule gRNA," "one-molecule guide NA," "single guide RNA", a "single-molecule guide RNA," a "one-molecule guide RNA", or a "sgRNA". In some embodiments, the sgRNA includes an "activator" or a "targeter" and thus can be an "activator-RNA" and a "targeter-RNA," respectively. In some embodiments, the gRNA is a ribonucleic acid molecule ("gRNA"), and in other embodiments, the gRNA is a chimera, and comprises both DNA and RNA. As used herein, the term gRNA cover naturally-occurring molecules, as well as sequence variants.

Site-specific binding and/or cleavage of a target nucleic acid sequence (e.g., genomic DNA) by the CasX variant protein can occur at one or more locations (e.g., a sequence of a target nucleic acid) determined by base-pairing complementarity between the targeting sequence of the gRNA and the target nucleic acid sequence. Thus, for example, and as described more fully, below, the gRNA variants of the disclosure have targeting sequences complementarity to and therefore can hybridize with the target nucleic acid that is adjacent to a sequence complementary to a TC PAM motif or a PAM sequence, such as ATC, CTC, GTC, or TTC. Because the targeting sequence of a guide sequence hybridizes with a sequence of a target nucleic acid sequence, a targeter can be modified by a user to hybridize with a specific target nucleic acid sequence, so long as the location of the PAM sequence is considered. Thus, in some cases, the sequence of a targeter may be a non-naturally occurring sequence. In other cases, the sequence of a targeter may be a naturally-occurring sequence, derived from the gene to be edited.

Collectively, the assembled gRNAs of the disclosure, including all gRNA variants, comprise distinct structured regions, or domains: the RNA triplex, the scaffold stem loop, the extended stem loop, the pseudoknot, and the targeting sequence that, in the embodiments of the disclosure is specific for a target nucleic acid and is located on the 3' end of the gRNA. The RNA triplex, the scaffold stem loop, the pseudoknot and the extended stem loop, together with the unstructured triplex loop that bridges portions of the triplex, together, are referred to as the "scaffold" of the gRNA. Each of the structured domains are critical to establish the global RNA fold of the guide and retain functionality of the guide; particularly the ability to properly complex with the CasX nuclease. For example, the guide scaffold stem interacts with the helical I domain of CasX nuclease, while residues within the triplex, triplex loop, and pseudoknot stem interact with the OBD of the CasX nuclease. Together, these interactions confer the ability of the guide to bind and form an RNP with the CasX that retains stability, while the spacer (or targeting sequence) directs and defines the specificity of the RNP for binding a specific sequence of DNA. The individual domains are described more fully, below.

b. RNA Triplex

In some embodiments of the guide NAs provided herein (including reference sgRNAs), there is a RNA-triplex, and the RNA triplex comprises the sequence of a UUU-nX(~4-15)-UUU (SEQ ID NO: 564) stem loop that ends with an AAAG after 2 intervening stem loops (the scaffold stem loop and the extended stem loop), forming a pseudoknot that may also extend past the triplex into a duplex pseudoknot. The UU-UUU-AAA sequence of the triplex forms as a nexus between the spacer, scaffold stem, and extended stem. In exemplary reference CasX sgRNAs, the UUU-loop-UUU region is coded for first, then the scaffold stem loop, and then the extended stem loop, which is linked by the tetraloop, and then an AAAG closes off the triplex before becoming the targeting sequence. The triplex, triplex loop, and pseudoknot stem interact with the OBD of the CasX nuclease. Together, these interactions define RNP binding and stability of the complex.

c. Scaffold Stem Loop

In some embodiments of CasX sgRNAs of the disclosure, the triplex region is followed by the scaffold stem loop. The scaffold stem loop is a region of the gRNA that is bound by CasX protein (such as a reference or CasX variant protein). In some embodiments, the scaffold stem loop is a fairly short and stable stem loop. In some cases, the scaffold stem loop does not tolerate many changes, and requires some form of an RNA bubble. The scaffold stem is necessary for CasX sgRNA function as it interacts with the helical I domain of the CasX. While it is perhaps analogous to the nexus stem of Cas9 as being a critical stem loop, the scaffold stem of a CasX sgRNA, in some embodiments, has a necessary bulge (RNA bubble) that is different from many other stem loops found in CRISPR/Cas systems. In some embodiments, the presence of this bulge is conserved across sgRNA that interact with different CasX proteins.

d. Extended Stem Loop

In some embodiments of the sgRNAs of the disclosure, the scaffold stem loop is followed by the extended stem loop. In some embodiments, the extended stem comprises a synthetic tracr and crRNA fusion that is largely unbound by the CasX protein. In some embodiments, the extended stem loop can be highly malleable. In some embodiments, a single guide gRNA is made with a GAAA tetraloop linker or a GAGAAA linker between the tracr and crRNA in the extended stem loop. In some cases, the targeter and activator of a CasX sgRNA are linked to one another by intervening nucleotides and the linker can have a length of from 3 to 20 nucleotides. In some embodiments of the CasX sgRNAs of the disclosure, the extended stem is a large 32-bp loop that sits outside of the CasX protein in the ribonucleoprotein complex. In some embodiments, the extended stem loop comprises a GAGAAA spacer sequence. In some embodiments, the extended stem loop is modified by insertion of C at position 64 and the A88G substitution relative to the sequence of SEQ ID NO: 2239, which resolves an asymmetrical bulge element of the extended stem, enhancing the stability of the extended stem of the gRNA scaffold.

In some embodiments, the disclosure provides gRNA variants wherein the extended stem loop is modified by inclusion of an RNA stem loop sequence from a heterologous RNA source with proximal 5' and 3' ends. In such cases, the heterologous RNA stem loop increases the stability of the gRNA.

In some embodiments, the disclosure provides gRNA variants for use in the XDP systems wherein the extended stem loop is modified with an RNA stem loop (sometimes also referred to as a hairpin loop) sequence from a heterologous RNA source with proximal 5' and 3' ends. In such cases, the heterologous RNA stem loop increases the stability of the gRNA. In some embodiments, RNA hairpin loops are incorporated into the extended stem confers non-covalent recruitment of the complexed CasX:gRNA into the budding XDP in the packaging host cell. Non-limiting examples of such non-covalent recruitment components include hairpin RNA or loops such as MS2 hairpin, PP7 hairpin, Qβ hairpin, boxB, transactivation response element (TAR), phage GA hairpin, phage ΛN hairpin, iron response element (IRE), and U1 hairpin II that have binding affinity for the NCR MS2 coat protein, PP7 coat protein, Qβ coat protein, protein N, protein Tat, phage GA coat protein, iron-responsive binding element (IRE) protein, and U1A signal recognition particle, respectively, that are incorporated in the protein-encoding nucleic acids used to transfect the packaging host cell. In some embodiments, the gRNA may further comprise a ligand for a peptide nuclear export signal (NES) within a binding protein that is able to facilitate the rapid nuclear export of the CRISPR RNA incorporating its ligand. Many such NES are known in the art. In a particular embodiment, the XDP system comprises HIV Rev protein and the RNA ligand is Rev response element (RRE) or a fragments thereof, such as RBE. The Rev effector domain has been shown to function as an autonomous NES (Fritz, C. C., et al. HIV Rev uses a conserved cellular protein export pathway for the nucleocytoplasmic transport of viral RNAs. Current Biol. 67:848 (1996)).

e. Targeting Sequence (a.k.a. Spacer)

In some embodiments of the gRNA of the disclosure utilized in the XDP systems, the extended stem loop is followed by a region that forms part of the triplex, and then the targeting sequence (or "spacer") linked at the 3' end of the gRNA scaffold. The targeting sequence targets the CasX ribonucleoprotein holo complex to a specific region of the target nucleic acid sequence of the gene to be modified. Thus, for example, gRNA targeting sequences of the disclosure are designed to have sequences complementarity to, and therefore can hybridize to, a portion of a target gene in a nucleic acid in a eukaryotic cell (e.g., a eukaryotic chromosome, chromosomal sequence, a eukaryotic RNA, etc.) as a component of the RNP when the TC PAM motif or any one of the PAM sequences TTC, ATC, GTC, or CTC is located 1 nucleotide 5' to the non-target strand sequence complementary to the target sequence. The targeting sequence of a gRNA can be modified so that the gRNA can target a desired sequence of any desired target nucleic acid sequence, so long as the PAM sequence location is taken into consideration. In some embodiments, the gRNA scaffold is 5' of the targeting sequence, with the targeting sequence on the 3' end of the gRNA. In some embodiments, the PAM motif sequence recognized by the nuclease of the RNP is TC. In other embodiments, the PAM sequence recognized by the nuclease of the RNP is NTC.

In some embodiments, the gRNA of the XDP systems comprises a targeting sequence (a) complementary to a nucleic acid sequence encoding i) a target protein, which may be a wild-type sequence or may comprise one or more mutations or ii) the accessory element of the protein, which may be a wild-type sequence; or (b) complementary to a complement of a nucleic acid sequence encoding a protein or its accessory element, which may comprise one or more mutations. In some embodiments, the targeting sequence of the gRNA is specific for a portion of a gene encoding a target protein comprising one or more mutations. In some embodiments, the targeting sequence of a gRNA is specific for a target gene exon. In some embodiments, the targeting sequence of a gRNA is specific for a target gene intron. In some embodiments, the targeting sequence of the gRNA is specific for a target gene intron-exon junction. In some embodiments, the targeting sequence of the gRNA is complementary to a sequence comprising one or more single nucleotide polymorphisms (SNPs) of the target gene or its complement. In other embodiments, the targeting sequence of the gRNA is complementary to a sequence of an intergenic region of the target gene or a sequence complementary to an intergenic region of the target gene.

In some embodiments, the targeting sequence of a gRNA is specific for an accessory element that regulates expression of a target gene. Such accessory elements include, but are not limited to promoter regions, enhancer regions, intergenic regions, 5' untranslated regions (5' UTR), 3' untranslated regions (3' UTR), intergenic regions, gene enhancer elements, conserved elements, and regions comprising cis-accessory elements. The promoter region is intended to encompass nucleotides within 5 kb of the target gene initiation point or, in the case of gene enhancer elements or conserved elements, can be 1 Mb or more distal to the target gene. In some embodiments, the disclosure provides a gRNA with a targeting sequence that hybridizes with target gene accessory element. In the foregoing, the targets are those in which the encoding gene of the target is intended to be knocked out or knocked down such that the target protein comprising mutations is not expressed or is expressed at a lower level in a cell. In some embodiments, the disclosure provides a CasX:gRNA system utilized in the XDP wherein the targeting sequence (or spacer) of the gRNA is complementary to a nucleic acid sequence encoding the target protein, a portion of the target protein, a portion of an accessory element, or the complement of a portion of a gene or an accessory element for the target gene. In some embodiments, the targeting sequence has between 14 and 30 consecutive nucleotides. In some embodiments, the targeting sequence has 14, 15, 16, 18, 18, 19, 20, 21, 22, 23 24, 25, 26, 27, 28, 29, or 30 consecutive nucleotides. In some embodiments, the targeting sequence consists of 20 consecutive nucleotides. In some embodiments, the targeting sequence consists of 19 consecutive nucleotides. In some embodiments, the targeting sequence consists of 18 consecutive nucleotides. In some embodiments, the targeting sequence consists of 17 consecutive nucleotides. In some embodiments, the targeting sequence consists of 16 nucleotides. In some embodiments, the targeting sequence consists of 15 nucleotides. In some embodiments, the targeting sequence can comprise 0 to 5, 0 to 4, 0 to 3, or 0 to 2 mismatches relative to the target nucleic acid sequence and retain sufficient binding specificity such that the RNP comprising the gRNA comprising the targeting sequence can form a complementary bond with respect to the target nucleic acid.

In some embodiments, the CasX:gRNA of the XDP system comprises a first gRNA and further comprises a second (and optionally a third, fourth or fifth) gRNA, wherein the second gRNA has a targeting sequence complementary a different portion of the target nucleic acid or its complement compared to the targeting sequence of the first gRNA. By selection of the targeting sequences of the gRNA, defined regions of the target nucleic acid can be modified or edited using the CasX:gRNA systems described herein. In some embodiments, the RNPs comprising the first and second gRNA variants are encapsidated in single XDP particles. In other embodiments, separate XDP particles are created that comprise RNPs having the first and the second gRNA variant, respectively, which are both used to contact and modify the target nuclei acid of the target cells.

f. gRNA Scaffolds

With the exception of the targeting sequence region, the remaining regions of the gRNA are referred to herein as the scaffold. In some embodiments, the gRNA scaffolds are derived from naturally-occurring sequences, described below as reference gRNA. In other embodiments, the gRNA scaffolds are variants of reference gRNA wherein mutations, insertions, deletions or domain substitutions are introduced to confer desirable properties on the gRNA variant.

In some embodiments, a CasX reference gRNA comprises a sequence isolated or derived from Deltaproteobacter. In some embodiments, a CasX reference guide RNA comprises a sequence isolated or derived from Planctomycetes. In still other embodiments, a CasX reference gRNA comprises a sequence isolated or derived from Candidatus Sungbacteria.

Table 7 provides the sequences of reference gRNAs tracr, cr and scaffold sequences. In some embodiments, the disclosure provides gRNA sequences wherein the gRNA has a scaffold comprising a sequence having at least one nucleotide modification relative to a reference gRNA sequence having a sequence of any one of SEQ ID NOS: 4-16 of Table 7. It will be understood that in those embodiments wherein a vector comprises a DNA encoding sequence for a gRNA, or a chimera of RNA and DNA, that thymine (T) bases can be substituted for the uracil (U) bases of any of the gRNA sequence embodiments described herein, including the sequences of Table 7 and Table 8. It will be further understood that in the foregoing embodiments, thymine (T) nucleotides can be substituted for one or more or all of the uracil (U) nucleotides in any of the targeting sequences such that the gRNA targeting sequence can be a gDNA or a gRNA, or a chimera of RNA and DNA.

TABLE 7

Reference gRNA tracr and scaffold sequences

| SEQ ID NO. | Nucleotide Sequence |
|---|---|
| 4 | ACAUCUGGCGCGUUUAUUCCAUUACUUUGGAGCCAGUCCCAG CGACUAUGUCGUAUGGACGAAGCGCUUAUUUAUCGGAGAGAA ACCGAUAAGUAAAACGCAUCAAAG |
| 5 | UACUGGCGCUUUUAUCUCAUUACUUUGAGAGCCAUCACCAGC GACUAUGUCGUAUGGGUAAAGCGCUUAUUUAUCGGAGAGAAA UCCGAUAAAUAAGAAGCAUCAAAG |
| 6 | ACAUCUGGCGCGUUUAUUCCAUUACUUUGGAGCCAGUCCCAG CGACUAUGUCGUAUGGACGAAGCGCUUAUUUAUCGGAGA |
| 7 | ACAUCUGGCGCGUUUAUUCCAUUACUUUGGAGCCAGUCCCAG CGACUAUGUCGUAUGGACGAAGCGCUUAUUUAUCGG |
| 8 | UACUGGCGCUUUUAUCUCAUUACUUUGAGAGCCAUCACCAGC GACUAUGUCGUAUGGGUAAAGCGCUUAUUUAUCGGAGA |
| 9 | UACUGGCGCUUUUAUCUCAUUACUUUGAGAGCCAUCACCAGC GACUAUGUCGUAUGGGUAAAGCGCUUAUUUAUCGG |
| 10 | GUUUACACACUCCCUCUCAUAGGGU |
| 11 | GUUUACACACUCCCUCUCAUGAGGU |
| 12 | UUUUACAUACCCCUCUCAUGGGAU |
| 13 | GUUUACACACUCCCUCUCAUGGGGG |
| 14 | CCAGCGACUAUGUCGUAUGG |
| 15 | GCGCUUAUUUAUCGGAGAGAAAUCCGAUAAAUAAGAAGC |
| 16 | GGCGCUUUUAUCUCAUUACUUUGAGAGCCAUCACCAGCGACU AUGUCGUAUGGGUAAAGCGCUUAUUUAUCGGA | g. gRNA Variants

In another aspect, the disclosure provides guide nucleic acid variants (referred to herein as "gRNA variant") for use in the XDP systems that comprise one or more modifications relative to a reference gRNA scaffold. As used herein, "scaffold" refers to all parts to the gRNA necessary for gRNA function with the exception of the targeting sequence.

In some embodiments, a gRNA variant comprises one or more nucleotide substitutions, insertions, deletions, or swapped or replaced regions relative to a reference gRNA sequence of the disclosure. In some embodiments, a mutation can occur in any region of a reference gRNA to produce a gRNA variant. In some embodiments, the scaffold of the gRNA variant sequence has at least 20%, at least 30%, at least 40%, at least 50%, at least 60%, or at least 70%, at least 80%, at least 85%, at least about 90%, at least about 95%, at least about 96%, at least about 97%, at least about 98%, or at least about 99% identity to the sequence of SEQ ID NO: 4 or SEQ ID NO: 5.

In some embodiments, a reference gRNA of the disclosure may be subjected to one or more mutagenesis methods, such as the mutagenesis methods described herein (as well as in PCT/US20/36506 and WO2020247883A2, incorporated by reference herein), which may include Deep Mutational Evolution (DME), deep mutational scanning (DMS), error prone PCR, cassette mutagenesis, random mutagenesis, staggered extension PCR, gene shuffling, or domain swapping, in order to generate one or more guide nucleic acid variants (referred to herein as "gRNA variant") with enhanced or varied properties relative to the reference gRNA. gRNA variants also include variants comprising one or more exogenous sequences, for example fused to either the 5' or 3' end, or inserted internally. The activity of reference gRNAs may be used as a benchmark against which the activity of gRNA variants are compared, thereby measuring improvements in function or other characteristics of the gRNA variants. In other embodiments, a reference gRNA may be subjected to one or more deliberate, specifically-targeted mutations in order to produce a gRNA variant, for example a rationally designed variant. Exemplary gRNA variants produced by such methods are described in the Examples and representative sequences of gRNA scaffolds are presented in Table 8.

In some embodiments, a gRNA variant comprises one or more nucleotide changes within one or more regions of the reference gRNA that improve a characteristic relative to the reference gRNA. Exemplary regions include the RNA triplex, the pseudoknot, the scaffold stem loop, and the extended stem loop. In some cases, the variant scaffold stem further comprises a bubble. In other cases, the variant scaffold further comprises a triplex loop region. In still other cases, the variant scaffold further comprises a 5' unstructured region. In one embodiment, the gRNA variant scaffold comprises a scaffold stem loop having at least 60% sequence identity to SEQ ID NO: 14. In another embodiment, the gRNA variant comprises a scaffold stem loop having the sequence of CCAGCGACUAUGUCGUAGUGG (SEQ ID NO: 568). In another embodiment, the disclosure provides a gRNA scaffold comprising, relative to SEQ ID NO: 5, a C18G substitution, a G55 insertion, a U1 deletion, and a modified extended stem loop in which the original 6 nt loop and 13 most-loop-proximal base pairs (32 nucleotides total) are replaced by a Uvsx hairpin (4 nt loop and 5 loop-proximal base pairs; 14 nucleotides total) and the loop-distal base of the extended stem was converted to a fully base-paired stem contiguous with the new Uvsx hairpin by deletion of the A99 and substitution of G64U. In the foregoing embodiment, the gRNA scaffold comprises the sequence (SEQ ID NO: 2238)
ACUGGCGCUUUUAUCUGAUUACUUUGAGAGCCAUCACCAGCGACUAUGUC

GUAGUGGGUAAAGCUCCCUCUUCGGAGGGAGCAUCAAAG.

In other cases, one or more mutations can be introduced in any region of a gRNA variant to produce another gRNA variant. All gRNA variants that have one or more improved functions or characteristics, or that add one or more new functions when the variant gRNA is compared to the gRNA variant from which it was derived are envisaged as within the scope of the disclosure. In some embodiments, the gRNA variant has an improved characteristic selected from the group consisting of increased editing activity, increased pseudoknot stem stability, increased triplex region stability, increased scaffold stem stability, extended stem stability, reduced off-target folding intermediates, and increased binding affinity to a Class 2, Type V CRISPR protein, or any combination thereof. In some cases of the foregoing, the improved characteristic is assessed in an in vitro assay, including the assays of the Examples. In other cases of the foregoing, the improved characteristic is assessed in vivo.

In some embodiments, the disclosure provides gRNA variants for use in the XDP systems comprising one or more modifications to the gRNA scaffold variant 174 (SEQ ID NO: 2238) selected from the group consisting of the modifications of Table 98, wherein the resulting gRNA variant exhibits an improved functional characteristic compared to the parent 174, when assessed in an in vitro or in vivo assay under comparable conditions. In some embodiments, the gRNA variants comprising one or more modifications to the gRNA scaffold variant 174 are selected from the group consisting of the modifications of Table 98 (with a linked targeting sequence and complexed with a CasX protein) exhibits an improved enrichment score (log$_2$) of at least about 2.0, at least about 2.5, at least about 3, or at least about 3.5 greater compared to the score of the gRNA scaffold of SEQ ID NO: 2238 in an in vitro assay, including the assays of the Examples described herein (e.g., Example 36). In a particular embodiment, the one or more modifications of gRNA scaffold variant 174 are selected from the group consisting of nucleotide positions U11, U24, A29, U65, C66, C68, A69, U76, G77, A79, and A87. In a particular embodiment, the modifications of gRNA scaffold variant 174 are U11C, U24C, A29C, U65C, C66G, C68U, an insertion of ACGGA at position 69, an insertion of UCCGU at position 76, G77A, an insertion of GA at position 79, and A87G.

In other exemplary embodiments, a gRNA variant for use in the XDP systems comprises one or more modifications relative to gRNA scaffold variant 175 (SEQ ID NO: 2239), wherein the resulting gRNA variant exhibits an improved functional characteristic compared to the parent 175, when assessed in an in vitro or in vivo assay under comparable conditions. For example, variants with modifications to the triplex loop of gRNA variant 175 show high enrichment relative to the 175 scaffold, particularly mutations to C15 or C17. Additionally, changes to either member of the predicted pair in the pseudoknot stem between G7 and A29 are both highly enriched relative to the 175 scaffold, with converting A29 to a C or a T to form a canonical Watson-Crick pairing (G7:C29), and the second of which would form a GU wobble pair (G7:U29), both of which may be expected to increase stability of the helix relative to the G:A pair. In addition, the insertion of a C at position 54 in guide scaffold 175 results in an enriched modification. In some embodiments, the disclosure provides gRNA variants comprising one or more modifications to the gRNA scaffold variant 175 (SEQ ID NO: 2239) are selected from the group consisting of the modifications of Table 99, wherein the resulting gRNA variant exhibits an improved functional characteristic compared to the parent 175, when assessed in an in vitro or in vivo assay under comparable conditions. In some embodiments, the gRNA variants comprising one or more modifications to the gRNA scaffold variant 175 are selected from the group consisting of the modifications of Table 99 (with a linked targeting sequence and complexed with a Class 2, Type V CRISPR protein) exhibits an improved enrichment score (log$_2$) of at least about 1.2, at least about 1.5, at least about 2.0, at least about 2.5, at least about 3, or at least about 3.5 greater compared to the score of the gRNA scaffold of SEQ ID NO: 2239 in an in vitro assay, including the assays of the Examples described herein (e.g., Example 36). In a particular embodiment, the modifications of gRNA scaffold variant 175 are selected from the group consisting of nucleotide positions C9, U11, C17, U24, A29, G54, C65, A89, and A96. In a particular embodiment, the modifications of gRNA scaffold variant 175 are C9U, U11C, C17G, U24C, A29C, an insertion of G at position 54, an insertion of C at position 65, A89G, and A96G. In one embodiment, the insertion of C at position 64 and the A88G substitution relative to the sequence of SEQ ID NO: 2239 resolves an asymmetrical bulge element of the extended stem, enhancing the stability of the extended stem of the gRNA scaffold. In another embodiment, the substitutions of U11C, U24C, and A95G relative to the sequence of SEQ ID NO: 2239 increases the stability of the triplex region of the gRNA scaffold. In another embodiment, the substitution of A29C relative to the sequence of SEQ ID NO: 2239 increases the stability of the pseudoknot stem. A representative example of such a gRNA variant with improved characteristics relative to gRNA variant from which it was derived is guide 235 (SEQ ID NO: 2292), the utility of which is described in the Examples.

In exemplary embodiments, a gRNA variant for use in the XDP systems comprises one or more modifications relative to gRNA scaffold variant 215 (SEQ ID NO:2275), wherein the resulting gRNA variant exhibits an improved functional characteristic compared to the parent 215, when assessed in an in vitro or in vivo assay under comparable conditions.

In exemplary embodiments, a gRNA variant for use in the XDP systems comprises one or more modifications relative to gRNA scaffold variant 221 (SEQ ID NO: 2281), wherein the resulting gRNA variant exhibits an improved functional characteristic compared to the parent 221, when assessed in an in vitro or in vivo assay under comparable conditions.

In exemplary embodiments, a gRNA variant for use in the XDP systems comprises one or more modifications relative to gRNA scaffold variant 225 (SEQ ID NO: 2285), wherein the resulting gRNA variant exhibits an improved functional characteristic compared to the parent 225, when assessed in an in vitro or in vivo assay under comparable conditions.

In exemplary embodiments, a gRNA variant for use in the XDP systems comprises one or more modifications relative to gRNA scaffold variant 235 (SEQ ID NO: 2292), wherein the resulting gRNA variant exhibits an improved functional characteristic compared to the parent 225, when assessed in an in vitro or in vivo assay under comparable conditions.

In exemplary embodiments, a gRNA variant for use in the XDP systems comprises one or more modifications relative to gRNA scaffold variant 251 (SEQ ID NO: 2308), wherein the resulting gRNA variant exhibits an improved functional characteristic compared to the parent 251, when assessed in an in vitro or in vivo assay under comparable conditions.

In some embodiments, the gRNA variant for use in the XDP systems comprises an exogenous extended stem loop, with such differences from a reference gRNA described as follows. In some embodiments, an exogenous extended stem loop has little or no identity to the reference stem loop regions disclosed herein (e.g., SEQ ID NO: 15). In some embodiments, an exogenous stem loop is at least 10 bp, at least 20 bp, at least 30 bp, at least 40 bp, at least 50 bp, at least 60 bp, at least 70 bp, at least 80 bp, at least 90 bp, at least 100 bp, at least 200 bp, at least 300 bp, at least 400 bp, or at least 500 bp. In some embodiments, the heterologous stem loop increases the stability of the gRNA. In some embodiments, the heterologous RNA stem loop is capable of binding a protein, an RNA structure, a DNA sequence, or a small molecule. In some embodiments, an exogenous stem loop region replacing the stem loop comprises an RNA stem loop or hairpin in which the resulting gRNA has increased stability and, depending on the choice of loop, can interact with certain cellular proteins for the non-covalent recruitment into budding XDP in the packaging host cell. Such exogenous extended stem loops can comprise, for example a thermostable RNA such as MS2 hairpin (ACAUGAGGAUCACCCAUGU (SEQ ID NO: 2011)), Qβ hairpin (AUGCAUGUCUAAGACAGCAU (SEQ ID NO: 2012)), U1 hairpin II (GGAAUCCAUUGCACUCCGGAUUUCACUAG (SEQ ID NO: 2013)), Uvsx (CCUCUUCGGAGG (SEQ ID NO: 2014)), PP7 hairpin (AAGGAGUUUAUAUGGAAACCCUU (SEQ ID NO: 2015)), Phage replication loop (AGGUGGGACGACCUCUCGGUCGUCCUAUCU (SEQ ID NO: 2016)), Kissing loop_a (UGCUCGCUCCGUUCGAGCA (SEQ ID NO: 2017)), Kissing loop_b1 (UGCUCGACGCGUCCUCGAGCA (SEQ ID NO: 2018)), Kissing loop_b2 (UGCUCGUUUGCGGCUACGAGCA (SEQ ID NO: 2019)), G quadriplex M3q (AGGGAGGGAGGGAGAGG (SEQ ID NO: 2020)), G quadriplex telomere basket (GGUUAGGGUUAGGGUUAGG (SEQ ID NO: 2021)), Sarcin-ricin loop (CUGCUCAGUACGAGAGGAACCGCAG (SEQ ID NO: 2022)), Pseudoknots (UACACUGGGAUCGCUGAAUUAGAGAUCGGCGUCCUUUCAUUCUAUAUACUUUGGAG UUUUAAAAUGUCUCUAAGUACA (SEQ ID NO: 2023)), transactivation response element (TAR) (GGCUCGUGUAGCUCAUUAGCUCCGAGCC (SEQ ID NO: 2024)), iron responsive element (IRE) CCGUGUGCAUCCGCAGUGUCGGAUCCACGG (SEQ ID NO: 2025)), phage GA hairpin (AAAACAUAAGGAAAACCUAUGUU (SEQ ID NO: 2026)), phage AN hairpin (aka boxB) (GCCCUGAAGAAGGGC (SEQ ID NO: 2027)), or sequence variants thereof. In some embodiments, one of the foregoing hairpin sequences is incorporated into the stem loop of the gRNA scaffold to help traffic the incorporation of the gRNA (and an associated CasX in an RNP complex) into a budding PDS (described more fully, below) when the counterpart ligand is incorporated into the MA fusion protein of the PDS.

Table 8 provides exemplary gRNA variant scaffold sequences of the disclosure for use in the XDP systems. In some embodiments, the gRNA variant scaffold comprises any one of the sequences listed in Table 8, or a sequence having at least about 50%, at least about 60%, at least about 70%, at least about 80%, at least about 90%, at least about 95%, at least about 95%, at least about 96%, at least about 97%, at least about 98%, at least about 99% sequence identity thereto, wherein the variant retains the capability to form an RNP with a CasX nuclease protein. In a particular embodiment, the gRNA variant scaffold for use in the XDP systems comprises the sequence of SEQ ID NO: 2249 or SEQ ID NO: 2308. It will be understood that in those embodiments wherein a vector comprises a DNA encoding sequence for a gRNA, or where a gRNA is a chimera of RNA and DNA, that thymine (T) bases can be substituted for the uracil (U) bases of any of the gRNA sequence embodiments described herein.

TABLE 8

Exemplary gRNA Variant Scaffold Sequences

| SEQ ID NO: | Variant | NUCLEOTIDE SEQUENCE OR DESCRIPTION OF VARIANT |
|---|---|---|
| 2238 | 174 | ACUGGCGCUUUUAUCUGAUUACUUUGAGAGCCAUCACCAGCGACUAUGUCGUAGUGGGU AAAGCUCCCUCUUCGGAGGGAGCAUCAAAG |
| 2239 | 175 | ACUGGCGCCUUUAUCUCAUUACUUUGAGAGCCAUCACCAGCGACUAUGUCGUAUGGGUA AAGCGCUUACGGACUUCGGUCCGUAAGAAGCAUCAAAG |
| 2240 | 176, 199 | GCUGGCGCUUUUAUCUGAUUACUUUGAGAGCCAUCACCAGCGACUAUGUCGUAGUGGGU AAAGCUCCCUCUUCGGAGGGAGCAUCAAAG |
| 2241 | 177 | ACUGGCGCUUUUAUCUGAUUACUUUGAGAGCCAUCACCAGCGACUAUGUCGUAUGGGUA AAGCUCCCUCUUCGGAGGGAGCAUCAAAG |
| 2259 | 179 | ACUGGCGCUUUUAUCUGAUUACUUUGAGAGCCAUCACCAGCGACUAUGUCGUAGUGGGU AAAUAGGAGCUGCACUAUGGGCGCAGUGUCAUUGACGCUGACGGUACAGGCCAGACAAU UAUUGUCUGGUAUAGUGCAGCUCCUAAUCAAAG |
| 2242 | 181 | ACUGGCGCCUUUAUCUGAUUACUUUGAGAGCCAUCACCAGCGACUAUGUCGUAUGGGUA AAGCGCUUACGGACUUCGGUCCGUAAGAAGCAUCAAAG |
| 2243 | 182 | ACUGGCGCUUUUAUCUGAUUACUUUGAGAGCCAUCACCAGCGACUAUGUCGUAUGGGUA AAGCGCUUACGGACUUCGGUCCGUAAGAAGCAUCAAAG |
| 2244 | 183 | ACUGGCGCUUUUAUCUGAUUACUUUGAGAGCCAUCACCAGCGACUAUGUCGUAGUGGGU AAAGCGCUUACGGACUUCGGUCCGUAAGAAGCAUCAAAG |

TABLE 8-continued

Exemplary gRNA Variant Scaffold Sequences

| SEQ ID NO: | Variant | NUCLEOTIDE SEQUENCE OR DESCRIPTION OF VARIANT |
|---|---|---|
| 2245 | 184 | ACUGGCGCUUUUAUCUGAUUACUUUGAGAGCCAUCACCAGCGACUAUGUCGUAUUGGGU<br>AAAGCUCCCUCUUCGGAGGGAGCAUCAAAG |
| 2246 | 185 | ACUGGCGCUUUUAUCUGAUUACUUUGAGAGCCAUCACCAGCGACUAUGUCGUAUUGGGU<br>AAAGCGCUUACGGACUUCGGUCCGUAAGAAGCAUCAAAG |
| 2247 | 186 | ACUGGCGCCUUUAUCAUCAUUACUUUGAGAGCCAUCACCAGCGACUAUGUCGUAUGGGU<br>AAAGCGCUUACGGACUUCGGUCCGUAAGAAGCAUCAAAG |
| 2248 | 187 | ACUGGCGCUUUUAUCUGAUUACUUUGAGAGCCAUCACCAGCGACUAUGUCGUAGUGGGU<br>AAAGCGCCCUCUUCGGAGGGAAGCAUCAAAG |
| 2249 | 188 | ACUGGCGCUUUUAUCUGAUUACUUUGAGAGCCAUCACCAGCGACUAUGUCGUAGUGGGU<br>AAAGCUCACAUGAGGAUCACCCAUGUGAGCAUCAAAG |
| 2250 | 189 | ACUGGCACUUUUACCUGAUUACUUUGAGAGCCAACACCAGCGACUAUGUCGUAGUGGGU<br>AAAGCUCCCUCUUCGGAGGGAGCAUCAAAG |
| 2251 | 190 | ACUGGCACUUUUAUCUGAUUACUUUGAGAGCCAUCACCAGCGACUAUGUCGUAGUGGGU<br>AAAGCUCCCUCUUCGGAGGGAGCAUCAAAG |
| 2252 | 191 | ACUGGCCCUUUUAUCUGAUUACUUUGAGAGCCAUCACCAGCGACUAUGUCGUAGUGGGU<br>AAAGCUCCCUCUUCGGAGGGAGCAUCAAAG |
| 2253 | 192 | ACUGGCGCUUUUACCUGAUUACUUUGAGAGCCAUCACCAGCGACUAUGUCGUAGUGGGU<br>AAAGCUCCCUCUUCGGAGGGAGCAUCAAAG |
| 2254 | 193 | ACUGGCGCUUUUAUCUGAUUACUUUGAGAGCCAACACCAGCGACUAUGUCGUAGUGGGU<br>AAAGCUCCCUCUUCGGAGGGAGCAUCAAAG |
| 2255 | 195 | ACUGGCACCUUUACCUGAUUACUUUGAGAGCCAACACCAGCGACUAUGUCGUAUGGGUA<br>AAGCGCUUACGGACUUCGGUCCGUAAGAAGCAUCAAAG |
| 2256 | 196 | ACUGGCACCUUUAUCUGAUUACUUUGAGAGCCAUCACCAGCGACUAUGUCGUAUGGGUA<br>AAGCGCUUACGGACUUCGGUCCGUAAGAAGCAUCAAAG |
| 2257 | 197 | ACUGGCCCCUUUAUCUGAUUACUUUGAGAGCCAUCACCAGCGACUAUGUCGUAUGGGUA<br>AAGCGCUUACGGACUUCGGUCCGUAAGAAGCAUCAAAG |
| 2258 | 198 | ACUGGCGCCUUUAUCUGAUUACUUUGAGAGCCAACACCAGCGACUAUGUCGUAUGGGUA<br>AAGCGCUUACGGACUUCGGUCCGUAAGAAGCAUCAAAG |
| 2260 | 200 | GACUGGCGCUUUUAUCUGAUUACUUUGAGAGCCAUCACCAGCGACUAUGUCGUAGUGGG<br>UAAAGCUCCCUCUUCGGAGGGAGCAUCAAAG |
| 2261 | 201 | ACUGGCGCCUUUAUCUGAUUACUUUGAGAGCCAUCACCAGCGACUAUGUCGUAGUGGG<br>UAAAGCUCCCUCUUCGGAGGGAGCAUCAAAG |
| 2262 | 202 | ACUGGCGCAUUUAUCUGAUUACUUUGUGAGCCAUCACCAGCGACUAUGUCGUAGUGGGU<br>AAAGCUCCCUCUUCGGAGGGAGCAUCAAAG |
| 2263 | 203 | ACUGGCGCCUUUAUCUGAUUACUUUGAGAGCCAUCACCAGCGACUAUGUCGUAGUGGGU<br>AAAGCUCCCUCUUCGGAGGGAGCAUCAAAG |
| 2264 | 204 | ACUGGCGCUUUUAUCUGAUUACUUUGAGAGCCAUCACCAGCGACUAUGUCGUAGUGGG<br>UAAAGCUCCCUCUUCGGAGGGAGCAUCAAAG |
| 2265 | 205 | ACUGGCGCAUUUAUCUGAUUACUUUGAGAGCCAUCACCAGCGACUAUGUCGUAGUGGGU<br>AAAGCUCCCUCUUCGGAGGGAGCAUCAAAG |
| 2266 | 206 | ACUGGCGCUUUUAUCUGAUUACUUUGUGAGCCAUCACCAGCGACUAUGUCGUAGUGGGU<br>AAAGCUCCCUCUUCGGAGGGAGCAUCAAAG |
| 2267 | 207 | ACUGGCGCUUUUAUUCUGAUUACUUUGAGAGCCAUCACCAGCGACUAUGUCGUAGUGGG<br>UAAAGCUCCCUCUUCGGAGGGAGCAUCAAAG |
| 2268 | 208 | ACGGCGCUUUUAUCUGAUUACUUUGAGAGCCAUCACCAGCGACUAUGUCGUAGUGGGUA<br>AAGCUCCCUCUUCGGAGGGAGCAUCAAAG |
| 2269 | 209 | ACUGGCGCUUUUAUAUGAUUACUUUGAGAGCCAUCACCAGCGACUAUGUCGUAGUGGGU<br>AAAGCUCCCUCUUCGGAGGGAGCAUCAAAG |
| 2270 | 210 | ACUGGCGCUUUUAUCUUGAUUACUUUGAGAGCCAUCACCAGCGACUAUGUCGUAGUGGG<br>UAAAGCUCCCUCUUCGGAGGGAGCAUCAAAG |

TABLE 8-continued

Exemplary gRNA Variant Scaffold Sequences

| SEQ ID NO: | Variant | NUCLEOTIDE SEQUENCE OR DESCRIPTION OF VARIANT |
|---|---|---|
| 2271 | 211 | ACUGGCGCUUUUAUCUGAUUACUUUGAGAGCCAGCACCAGCGACUAUGUCGUAGUGGGU<br>AAAGCUCCCUCUUCGGAGGGAGCAUCAAAG |
| 2272 | 212 | ACUGGCGCUGUUAUCUGAUUACUUCGAGAGCCAUCACCAGCGACUAUGUCGUAGUGGGU<br>AAAGCUCCCUCUUCGGAGGGAGCAUCGAAG |
| 2273 | 213 | ACUGGCGCUCUUAUCUGAUUACUUCGAGAGCCAUCACCAGCGACUAUGUCGUAGUGGGU<br>AAAGCUCCCUCUUCGGAGGGAGCAUCGAAG |
| 2274 | 214 | ACUGGCGCUUGUAUCUGAUUACUCUGAGAGCCAUCACCAGCGACUAUGUCGUAGUGGGU<br>AAAGCUCCCUCUUCGGAGGGAGCAUCAGAG |
| 2275 | 215 | ACUGGCGCUUCUAUCUGAUUACUCUGAGAGCCAUCACCAGCGACUAUGUCGUAGUGGGU<br>AAAGCUCCCUCUUCGGAGGGAGCAUCAGAG |
| 2276 | 216 | ACUGGCGCUUUGAUCUGAUUACCUUGAGAGCCAUCACCAGCGACUAUGUCGUAGUGGGU<br>AAAGCUCCCUCUUCGGAGGGAGCAUCAAGG |
| 2277 | 217 | ACUGGCGCUUUCAUCUGAUUACCUUGAGAGCCAUCACCAGCGACUAUGUCGUAGUGGGU<br>AAAGCUCCCUCUUCGGAGGGAGCAUCAAGG |
| 2278 | 218 | ACUGGCGCUGUUAUCUGAUUACUUUGAGAGCCAUCACCAGCGACUAUGUCGUAGUGGGU<br>AAAGCUCCCUCUUCGGAGGGAGCAUCAAAG |
| 2279 | 219 | ACUGGCGCUUUUAUCUGAUUACUUUGAGAGCCAUCACCAGCGACUAUGUCGUAGUGGGU<br>AAAGCUCCCUCUUCGGAGGGAGCAUCGAAG |
| 2280 | 220 | ACUGGCGCUUUUAUCUGAUUACUUCGAGAGCCAUCACCAGCGACUAUGUCGUAGUGGGU<br>AAAGCUCCCUCUUCGGAGGGAGCAUCAAAG |
| 2281 | 221 | ACUGGCACUUCUAUCUGAUUACUCUGAGAGCCAUCACCAGCGACUAUGUCGUAUGGGUA<br>AAGCCGCUUACGGACUUCGGUCCGUAAGAGGCAUCAGAG |
| 2282 | 222 | ACUGGCACUUCUAUCUGAUUACUCUGAGAGCCAUCACCAGCGACUAUGUCGUAGUGGGU<br>AAAGCUCCCUCUUCGGAGGGAGCAUCAGAG |
| 2283 | 223 | ACUGGCACCUUUAUCUGAUUACUUUGAGAGCCAUCACCAGCGACUAUGUCGUAUGGGUA<br>AAGCCGCUUACGGACUUCGGUCCGUAAGAGGCAUCAAAG |
| 2284 | 224 | ACUGGCACUUGUAUCUGAUUACUCUGAGAGCCAUCACCAGCGACUAUGUCGUAUGGGUA<br>AAGCCGCUUACGGACUUCGGUCCGUAAGAGGCAUCAGAG |
| 2285 | 225 | ACUGGCACUUGUAUCUGAUUACUCUGAGAGCCAUCACCAGCGACUAUGUCGUAGUGGGU<br>AAAGCUCCCUCUUCGGAGGGAGCAUCAGAG |
| 2380 | 226 | ACUGGCGCUUUUAUCUGAUUACUUUGAGAGCCAUCACCAGCGACUAUGUCGUAG<br>UGGGUAAAGCUGCACUAUGGGCGCAGCGUCAAUGACGCUGACGGUACAGGCCAG<br>ACAAUUAUUGUCUGGUAUAGUGCAGCAUCAAAG |
| 2373 | 227 | ACUGGCGCUUUUAUCUGAUUACUUUGAGAGCCAUCACCAGCGACUAUGUCGUAGUGGGU<br>AAAGCUAGGAGCUUUGUUCCUUGGGUUCUUGGGAGCAGCAGGAAGCACUAUGGGCGCAG<br>CGUCAAUGACGCUGACGGUACAGGCCAGACAAUUAUUGUCUGGUAUAGUGCAGCAGCAG<br>AACAAUUUGCUGAGGGCUAUUGAGGCGCAACAGCAUCUGUUGCAACUCACAGUCUGGGG<br>CAUCAAGCAGCUCCAGGCAAGAAUCCUGGCUGUGGAAAGAUACCUAAAGGAUCAACAGC<br>UCCUAGCAUCAAAG |
| 2374 | 228 | ACUGGCGCUUUUAUCUGAUUACUUUGAGAGCCAUCACCAGCGACUAUGUCGUAGUGGGU<br>AAAGCUCCCCGUACACCAUCAGGGUACGGGGAGCAUCAAAG |
| 2286 | 229 | ACUGGCACUUUAUCUGAUUACUUUGAGAGCCAUCACCAGCGACUAUGUCGUAUGGGUA<br>AAGCGCUUACGGACUUCGGUCCGUAAGAAGCAUCAAAG |
| 2287 | 230 | ACUGGCACUUCUAUCUGAUUACUCUGAGAGCCAUCACCAGCGACUAUGUCGUAUGGGUA<br>AAGCGCUUACGGACUUCGGUCCGUAAGAAGCAUCAGAG |
| 2288 | 231 | ACUGGCGCUUCUAUCUGAUUACUCUGAGAGCCAUCACCAGCGACUAUGUCGUAUGGGUA<br>AAGCCGCUUACGGACUUCGGUCCGUAAGAGGCAUCAGAG |
| 2289 | 232 | ACUGGCACUUCUAUCUGAUUACUCUGAGCGCCAUCACCAGCGACUAUGUCGUAUGGGUA<br>AAGCCGCUUACGGACUUCGGUCCGUAAGAGGCAUCAGAG |
| 2290 | 233 | ACUGGCGCUUCUAUCUGAUUACUCUGAGCGCCAUCACCAGCGACUAUGUCGUAUGGGUA<br>AAGCCGCUUACGGACUUCGGUCCGUAAGAGGCAUCAGAG |

TABLE 8-continued

Exemplary gRNA Variant Scaffold Sequences

| SEQ ID NO: | Variant | NUCLEOTIDE SEQUENCE OR DESCRIPTION OF VARIANT |
|---|---|---|
| 2291 | 234 | ACUGGCGCUUCUAUCUGAUUACUCUGAGCGCCAUCACCAGCGACUAUGUCGUAUGGGUA AAGCGCCUUACGGACUUCGGUCCGUAAGGAGCAUCAGAG |
| 2292 | 235 | ACUGGCGCUUCUAUCUGAUUACUCUGAGCGCCAUCACCAGCGACUAUGUCGUAGUGGGU AAAGCCGCUUACGGACUUCGGUCCGUAAGAGGCAUCAGAG |
| 2293 | 236 | ACGGGACUUUCUAUCUGAUUACUCUGAAGUCCCUCACCAGCGACUAUGUCGUAUGGGUA AAGCCGCUUACGGACUUCGGUCCGUAAGAGGCAUCAGAG |
| 2294 | 237 | ACCUGUAGUUCUAUCUGAUUACUCUGACUACAGUCACCAGCGACUAUGUCGUAUGGGUA AAGCCGCUUACGGACUUCGGUCCGUAAGAGGCAUCAGAG |
| 2295 | 238 | ACUGGCGCUUUUAUCUGAUUACUUUGAGAGCCAUCACCAGCGACUAUGUCGUAGUGGGU AAAGCUGCACGGUGGGCGCAGCUUCGGCUGACGGUACACCGUGCAGCAUCAAAG |
| 2296 | 239 | ACUGGCGCUUUUAUCUGAUUACUUUGAGAGCCAUCACCAGCGACUAUGUCGUAGUGGGU AAAGCUGCACGGUGGGCGCAGCUUCGGCUGACGGUACACCGGUGGGCGCAGCUUCGGCU GACGGUACACCGUGCAGCAUCAAAG |
| 2297 | 240 | ACUGGCGCUUUUAUCUGAUUACUUUGAGAGCCAUCACCAGCGACUAUGUCGUAGUGGGU AAAGCUGCACGGUGGGCGCAGCUUCGGCUGACGGUACACCGGUGGGCGCAGCUUCGGCU GACGGUACACCGGUGGGCGCAGCUUCGGCUGACGGUACACCGUGCAGCAUCAAAG |
| 2298 | 241 | ACUGGCGCUUUUAUCUGAUUACUUUGAGAGCCAUCACCAGCGACUAUGUCGUAGUGGGU AAAGCUGCACGGUGGGCGCAGCUUCGGCUGACGGUACACCGGUGGGCGCAGCUUCGGCU GACGGUACACCGGUGGGCGCAGCUUCGGCUGACGGUACACCGGUGGGCGCAGCUUCGGC UGACGGUACACCGUGCAGCAUCAAAG |
| 2299 | 242 | ACUGGCGCUUUUAUCUGAUUACUUUGAGAGCCAUCACCAGCGACUAUGUCGUAGUGGGU AAAGCUGCACGGUGGGCGCAGCUUCGGCUGACGGUACACCGGUGGGCGCAGCUUCGGCU GACGGUACACCGGUGGGCGCAGCUUCGGCUGACGGUACACCGGUGGGCGCAGCUUCGGC UGACGGUACACCGGUGGGCGCAGCUUCGGCUGACGGUACACCGUGCAGCAUCAAAG |
| 2300 | 243 | ACUGGCGCUUUUAUCUGAUUACUUUGAGAGCCAUCACCAGCGACUAUGUCGUAGUGGGU AAAGCUGCACCUAGCGGAGGCUAGGUGCAGCAUCAAAG |
| 2301 | 244 | ACUGGCGCUUUUAUCUGAUUACUUUGAGAGCCAUCACCAGCGACUAUGUCGUAGUGGGU AAAGCUGCACCUCGGCUUGCUGAAGCGCGCACGGCAAGAGGCGAGGUGCAGCAUCAAAG |
| 2302 | 245 | ACUGGCGCUUUUAUCUGAUUACUUUGAGAGCCAUCACCAGCGACUAUGUCGUAGUGGGU AAAGCUGCACCUCUCUCGACGCAGGACUCGGCUUGCUGAAGCGCGCACGGCAAGAGGCG AGGGGCGGCGACUGGUGAGUACGCCAAAAAUUUUGACUAGCGGAGGCUAGAAGGAGAGA GGUGCAGCAUCAAAG |
| 2303 | 246 | ACUGGCGCUUUUAUCUGAUUACUUUGAGAGCCAUCACCAGCGACUAUGUCGUAGUGGGU AAAGCUGCACGGUGCCCGUCUGUUGUGUCGAGAGACGCCAAAAAUUUUGACUAGCGGAG GCUAGAAGGAGAGAGAUGGGUGCCGUGCAGCAUCAAAG |
| 2304 | 247 | ACUGGCGCUUUUAUCUGAUUACUUUGAGAGCCAUCACCAGCGACUAUGUCGUAGUGGGU AAAGCUGCACAUGGAGAGGAGAUGUGCAGCAUCAAAG |
| 2305 | 248 | ACUGGCGCUUUUAUCUGAUUACUUUGAGAGCCAUCACCAGCGACUAUGUCGUAGUGGGU AAAGCUGCACAUGGAGAUGUGCAGCAUCAAAG |
| 2306 | 249 | ACUGGCGCUUUUAUCUGAUUACUUUGAGAGCCAUCACCAGCGACUAUGUCGUAGUGGGU AAAGCUUGGGCGCAGCGUCAAUGACGCUGACGGUACAAGCAUCAAAG |
| 2307 | 250 | ACUGGCGCUUUUAUCUGAUUACUUUGAGAGCCAUCACCAGCGACUAUGUCGUAGUGGGU AAAGCUGCACUAUGGGCGCAGCGUCAAUGACGCUGACGGUACAGGCCACAUGAGGAUCA CCCAUGUGGUAUAGUGCAGCAUCAAAG |
| 2308 | 251 | ACUGGCGCUUUUAUCUGAUUACUUUGAGAGCCAUCACCAGCGACUAUGUCGUAGUGGGU AAAGCUGCACUAUGGGCGCAGCUCAUGAGGAUCACCCAUGAGCUGACGGUACAGGCCAC AUGAGGAUCACCCAUGUGGUAUAGUGCAGCAUCAAAG |
| 2309 | 252 | ACUGGCGCUUUUAUCUGAUUACUUUGAGAGCCAUCACCAGCGACUAUGUCGUAGUGGGU AAAGCUGCACUAUGGGCGCAGCGUCAAUGACGCUGACGGUACAGGCCACAUGGCAGUCG UAACGACGCGGGUGGUAUAGUGCAGCAUCAAAG |
| 2310 | 253 | ACUGGCGCUUUUAUCUGAUUACUUUGAGAGCCAUCACCAGCGACUAUGUCGUAGUGGGU AAAGCUGCACUAUGGGCGCAGCAAACAUGGCAGUCCUAAGGACGCGGGUUUUGCUGACG GUACAGGCCACAUGGCAGUCGUAACGACGCGGGUGGUAUAGUGCAGCAUCAAAG |

TABLE 8-continued

Exemplary gRNA Variant Scaffold Sequences

| SEQ ID NO: | Variant | NUCLEOTIDE SEQUENCE OR DESCRIPTION OF VARIANT |
|---|---|---|
| 2311 | 254 | ACUGGCGCUUUUAUCUGAUUACUUUGAGAGCCAUCACCAGCGACUAUGUCGUAGUGGGU AAAGCUGCACUAUGGGCGCAGACAUGGCAGUCGUAACGACGCGGGUCUGACGGUACAGG CCACAUGAGGAUCACCCAUGUGGUAUAGUGCAGCAUCAAAG |
| 2312 | 255 | ACUGGCGCUUUUAUCUGAUUACUUUGAGAGCCAUCACCAGCGACUAUGUCGUAGUGGGU AAAGCUGCACUAAGGAGUUUAUAUGGAAACCCUUAGUGCAGCAUCAAAG |
| 2313 | 256 | ACUGGCGCUUUUAUCUGAUUACUUUGAGAGCCAUCACCAGCGACUAUGUCGUAGUGGGU AAAGCUCAGGAAGCACUAUGGGCGCAGCGUCAAUGACGCUGACGGUACAGGCCAGACAA UUAUUGUCUGGUAUAGUGCAGCAGCAGAACAAUUUGCUGAGGGCUAUUGAGGCGCAACA GCAUCUGUUGCAACUCACAGUCUGGGGCAUCAAGCAGCUCCAGGCAAGAAUCCUGAGCA UCAAAG |
| 2314 | 257 | ACUGGCGCUUUUAUCUGAUUACUUUGAGAGCCAUCACCAGCGACUAUGUCGUAGUGGGU AAAGCUGCACGCCCUGAAGAAGGGCGUGCAGCAUCAAAG |
| 2315 | 258 | ACUGGCGCUUUUAUCUGAUUACUUUGAGAGCCAUCACCAGCGACUAUGUCGUAGUGGGU AAAGCUGCACGGCUCGUGUAGCUCAUUAGCUCCGAGCCGUGCAGCAUCAAAG |
| 2316 | 259 | ACUGGCGCUUUUAUCUGAUUACUUUGAGAGCCAUCACCAGCGACUAUGUCGUAGUGGGU AAAGCUGCACCCGUGUGCAUCCGCAGUGUCGGAUCCACGGGUGCAGCAUCAAAG |
| 2317 | 260 | ACUGGCGCUUUUAUCUGAUUACUUUGAGAGCCAUCACCAGCGACUAUGUCGUAGUGGGU AAAGCUGCACGGAAUCCAUUGCACUCCGGAUUUCACUAGGUGCAGCAUCAAAG |
| 2318 | 261 | ACUGGCGCUUUUAUCUGAUUACUUUGAGAGCCAUCACCAGCGACUAUGUCGUAGUGGGU AAAGCUGCACAUGCAUGCUAAGACAGCAUGUGCAGCAUCAAAG |
| 2319 | 262 | ACUGGCGCUUUUAUCUGAUUACUUUGAGAGCCAUCACCAGCGACUAUGUCGUAGUGGGU AAAGCUGCACAAAACAUAAGGAAAACCUAUGUUGUGCAGCAUCAAAG |
| 2320 | 263 | ACUGGCGCUUCUAUCUGAUUACUCUGAGCGCCAUCACCAGCGACUAUGUCGUAGUGGGU AAAGCCGCUUACGGACUAUGGGCGCAGCGUCAAUGACGCUGACGGUACAGGCCAGACAA UUAUUGUCUGGUAUAGUCCGUAAGAGGCAUCAGAG |
| 2321 | 264 | ACUGGCGCUUCUAUCUGAUUACUCUGAGCGCCAUCACCAGCGACUAUGUCGUAGUGGGU AAAGCCGCUUACGGGUGGCGCAGCGUCAAUGACGCUGACGGUACAGGCCAGACAAUUA UUGUCUGGUACCCGUAAGAGGCAUCAGAG |
| 2322 | 265 | ACUGGCGCUUCUAUCUGAUUACUCUGAGCGCCAUCACCAGCGACUAUGUCGUAGUGGGU AAAGCCGCUUACGGACUAUGGGCGCAGCGUCAAUGACGCUGACGGUACAGGCCACAUGA GGAUCACCCAUGUGGUAUAGUCCGUAAGAGGCAUCAGAG |
| 2323 | 266 | ACUGGCGCUUUUAUCUGAUUACUUUGAGAGCCAUCACCAGCGACUAUGUCGUAGUGGGU AAAGCUCCCUAUGGGCGCAGCGUCAAUGACGCUGACGGUACAGGCCACAUGAGGAUCAC CCAUGUGGUAUAGGGAGCAUCAAAG |
| 2324 | 267 | ACUGGCGCUUCUAUCUGAUUACUCUGAGCGCCAUCACCAGCGACUAUGUCGUAGUGGGU AAAGCCGCUUACGGACUAUGGGCGCAGCUCAUGAGGAUCACCCAUGAGCUGACGGUACA GGCCACAUGAGGAUCACCCAUGUGGUAUAGUCCGUAAGAGGCAUCAGAG |
| 2325 | 268 | ACUGGCGCUUUUAUCUGAUUACUUUGAGAGCCAUCACCAGCGACUAUGUCGUAGUGGGU AAAGCUCCCUAUGGGCGCAGCUCAUGAGGAUCACCCAUGAGCUGACGGUACAGGCCACA UGAGGAUCACCCAUGUGGUAUAGGGAGCAUCAAAG |
| 2326 | 269 | ACUGGCGCUUCUAUCUGAUUACUCUGAGCGCCAUCACCAGCGACUAUGUCGUAGUGGGU AAAGCCGCUUACGGACUAUGGGCGCAGCGUCAAUGACGCUGACGGUACAGGCCACAUGG CAGUCGUAACGACGCGGGUGGUAUAGUCCGUAAGAGGCAUCAGAG |
| 2327 | 270 | ACUGGCGCUUUUAUCUGAUUACUUUGAGAGCCAUCACCAGCGACUAUGUCGUAGUGGGU AAAGCUCCCUAUGGGCGCAGCGUCAAUGACGCUGACGGUACAGGCCACAUGGCAGUCGU AACGACGCGGGUGGUAUAGGGAGCAUCAAAG |
| 2328 | 271 | ACUGGCGCUUCUAUCUGAUUACUCUGAGCGCCAUCACCAGCGACUAUGUCGUAGUGGGU AAAGCCGCUUACGGACUAUGGGCGCAGCAAACAUGGCAGUCCUAAGGACGCGGGUUUUG CUGACGGUACAGGCCACAUGGCAGUCGUAACGACGCGGGUGGUAUAGUCCGUAAGAGGC AUCAGAG |
| 2329 | 272 | ACUGGCGCUUUUAUCUGAUUACUUUGAGAGCCAUCACCAGCGACUAUGUCGUAGUGGGU AAAGCUCCCUAUGGGCGCAGCAAACAUGGCAGUCCUAAGGACGCGGGUUUUGCUGACGG UACAGGCCACAUGGCAGUCGUAACGACGCGGGUGGUAUAGGGAGCAUCAAAG |

TABLE 8-continued

Exemplary gRNA Variant Scaffold Sequences

| SEQ ID NO: | Variant | NUCLEOTIDE SEQUENCE OR DESCRIPTION OF VARIANT |
|---|---|---|
| 2330 | 273 | ACUGGCGCUUCUAUCUGAUUACUCUGAGCGCCAUCACCAGCGACUAUGUCGUAGUGGGU<br>AAAGCCGCUUACGGACUAUGGGCGCAGACAUGGCAGUCGUAACGACGCGGGUCUGACGG<br>UACAGGCCACAUGAGGAUCACCCAUGUGGUAUAGUCCGUAAGAGGCAUCAGAG |
| 2331 | 274 | ACUGGCGCUUUUAUCUGAUUACUUUGAGAGCCAUCACCAGCGACUAUGUCGUAG<br>UGGGUAAAGCUCCCUAUGGGCGCAGACAUGGCAGUCGUAACGACGCGGGUCUGA<br>CGGUACAGGCCACAUGAGGAUCACCCAUGUGGUAUAGGGAGCAUCAAAG |
| 2332 | 275 | ACUGGCGCUUUUAUCUGAUUACUUUGAGAGCCAUCACCAGCGACUAUGUCGUAG<br>UGGGUAAAGCUGCACUAUGGGCGCAGCACCUGAGGAUCACCCAGGUGCUGACGG<br>UACAGGCCACCUGAGGAUCACCCAGGUGGUAUAGUGCAGCAUCAAAG |
| 2333 | 276 | ACUGGCGCUUUUAUCUGAUUACUUUGAGAGCCAUCACCAGCGACUAUGUCGUAG<br>UGGGUAAAGCUGCACUAUGGGCGCAGCGCAUGAGGAUCACCCAUGCGCUGACGG<br>UACAGGCCGCAUGAGGAUCACCCAUGCGGUAUAGUGCAGCAUCAAAG |
| 2334 | 277 | ACUGGCGCUUUUAUCUGAUUACUUUGAGAGCCAUCACCAGCGACUAUGUCGUAG<br>UGGGUAAAGCUGCACUAUGGGCGCAGCGCCUGAGGAUCACCCAGGCGCUGACGG<br>UACAGGCCGCCUGAGGAUCACCCAGGCGGUAUAGUGCAGCAUCAAAG |
| 2335 | 278 | ACUGGCGCUUUUAUCUGAUUACUUUGAGAGCCAUCACCAGCGACUAUGUCGUAG<br>UGGGUAAAGCUGCACUAUGGGCGCAGCGCCUGAGCAUCAGCCAGGCGCUGACGG<br>UACAGGCCGCCUGAGCAUCAGCCAGGCGGUAUAGUGCAGCAUCAAAG |
| 2336 | 279 | ACUGGCGCUUUUAUCUGAUUACUUUGAGAGCCAUCACCAGCGACUAUGUCGUAG<br>UGGGUAAAGCUGCACUAUGGGCGCAGCACAUGAGCAUCAGCCAUGUGCUGACGG<br>UACAGGCCACAUGAGCAUCAGCCAUGUGGUAUAGUGCAGCAUCAAAG |
| 2337 | 280 | ACUGGCGCUUUUAUCUGAUUACUUUGAGAGCCAUCACCAGCGACUAUGUCGUAG<br>UGGGUAAAGCUGCACUAUGGGCGCAGCACAUGAGUAUCAACCAUGUGCUGACGG<br>UACAGGCCACAUGAGUAUCAACCAUGUGGUAUAGUGCAGCAUCAAAG |
| 2338 | 281 | ACUGGCGCUUUUAUCUGAUUACUUUGAGAGCCAUCACCAGCGACUAUGUCGUAG<br>UGGGUAAAGCUGCACUAUGGGCGCAGCACAUGAGAAUCAGCCAUGUGCUGACGG<br>UACAGGCCACAUGAGAAUCAGCCAUGUGGUAUAGUGCAGCAUCAAAG |
| 2339 | 282 | ACUGGCGCUUUUAUCUGAUUACUUUGAGAGCCAUCACCAGCGACUAUGUCGUAG<br>UGGGUAAAGCUGCACUAUGGGCGCAGCCCUUGAGGAUCACCCAUGUGCUGACGG<br>UACAGGCCCCUUGAGGAUCACCCAUGUGGUAUAGUGCAGCAUCAAAG |
| 2340 | 283 | ACUGGCGCUUUUAUCUGAUUACUUUGAGAGCCAUCACCAGCGACUAUGUCGUAG<br>UGGGUAAAGCUGCACUAUGGGCGCAGCACUUGAGGAUCACCCAUGUGCUGACGG<br>UACAGGCCACUUGAGGAUCACCCAUGUGGUAUAGUGCAGCAUCAAAG |
| 2341 | 284 | ACUGGCGCUUUUAUCUGAUUACUUUGAGAGCCAUCACCAGCGACUAUGUCGUAG<br>UGGGUAAAGCUGCACUAUGGGCGCAGCACCUGAGGAUCACCCAUGUGCUGACGG<br>UACAGGCCACCUGAGGAUCACCCAUGUGGUAUAGUGCAGCAUCAAAG |
| 2342 | 285 | ACUGGCGCUUUUAUCUGAUUACUUUGAGAGCCAUCACCAGCGACUAUGUCGUAG<br>UGGGUAAAGCUGCACUAUGGGCGCAGCACAUGAGGAUCACCUAUGUGCUGACGG<br>UACAGGCCACAUGAGGAUCACCUAUGUGGUAUAGUGCAGCAUCAAAG |
| 2343 | 286 | ACUGGCGCUUUUAUCUGAUUACUUUGAGAGCCAUCACCAGCGACUAUGUCGUAG<br>UGGGUAAAGCUGCACUAUGGGCGCAGCACAUUAGGAUCACCAAUGUGCUGACGG<br>UACAGGCCACAUUAGGAUCACCAAUGUGGUAUAGUGCAGCAUCAAAG |
| 2344 | 287 | ACUGGCGCUUUUAUCUGAUUACUUUGAGAGCCAUCACCAGCGACUAUGUCGUAG<br>UGGGUAAAGCUGCACUAUGGGCGCAGCACAUUAGGAUCACCGAUGUGCUGACGG<br>UACAGGCCACAUUAGGAUCACCGAUGUGGUAUAGUGCAGCAUCAAAG |
| 2345 | 288 | ACUGGCGCUUUUAUCUGAUUACUUUGAGAGCCAUCACCAGCGACUAUGUCGUAG<br>UGGGUAAAGCUGCACUAUGGGCGCAGCACAUUAGGAUCACCUAUGUGCUGACGG<br>UACAGGCCACAUUAGGAUCACCUAUGUGGUAUAGUGCAGCAUCAAAG |
| 2346 | 289 | ACUGGCGCUUUUAUCUGAUUACUUUGAGAGCCAUCACCAGCGACUAUGUCGUAG<br>UGGGUAAAGCUGCACUAUGGGCGCAGCACAUGAGGAUUACCCAUGUGCUGACGG<br>UACAGGCCACAUGAGGAUUACCCAUGUGGUAUAGUGCAGCAUCAAAG |
| 2347 | 290 | ACUGGCGCUUUUAUCUGAUUACUUUGAGAGCCAUCACCAGCGACUAUGUCGUAG<br>UGGGUAAAGCUGCACUAUGGGCGCAGCACAUGAGGAUAACCCAUGUGCUGACGG<br>UACAGGCCACAUGAGGAUAACCCAUGUGGUAUAGUGCAGCAUCAAAG |

TABLE 8-continued

Exemplary gRNA Variant Scaffold Sequences

| SEQ ID NO: | Variant | NUCLEOTIDE SEQUENCE OR DESCRIPTION OF VARIANT |
|---|---|---|
| 2348 | 291 | ACUGGCGCUUUUAUCUGAUUACUUUGAGAGCCAUCACCAGCGACUAUGUCGUAG UGGGUAAAGCUGCACUAUGGGCGCAGCACAUGAGGAUGACCCAUGUGCUGACGG UACAGGCCACAUGAGGAUGACCCAUGUGGUAUAGUGCAGCAUCAAAG |
| 2349 | 292 | ACUGGCGCUUUUAUCUGAUUACUUUGAGAGCCAUCACCAGCGACUAUGUCGUAG UGGGUAAAGCUGCACUAUGGGCGCAGCACAUGAGGACCACCCAUGUGCUGACGG UACAGGCCACAUGAGGACCACCCAUGUGGUAUAGUGCAGCAUCAAAG |
| 2350 | 293 | ACUGGCGCUUUUAUCUGAUUACUUUGAGAGCCAUCACCAGCGACUAUGUCGUAG UGGGUAAAGCUGCACUAUGGGCGCAGCAGAUGAGGAUCACCCAUGGGCUGACGG UACAGGCCAGAUGAGGAUCACCCAUGGGGUAUAGUGCAGCAUCAAAG |
| 2351 | 294 | ACUGGCGCUUUUAUCUGAUUACUUUGAGAGCCAUCACCAGCGACUAUGUCGUAG UGGGUAAAGCUGCACUAUGGGCGCAGCACAUGGGGAUCACCCAUGUGCUGACGG UACAGGCCACAUGGGGAUCACCCAUGUGGUAUAGUGCAGCAUCAAAG |
| 2352 | 295 | ACUGGCGCUUUUAUCUGAUUACUUUGAGAGCCAUCACCAGCGACUAUGUCGUAG UGGGUAAAGCUGCACUAUGGGCGCAGCACAUGAGGAUCACCCAUGUGCUGACGG UACAGGCCACAUGAGGAUCACCCAUGUGGUAUAGUGCAGCAUCAAAG |
| 2353 | 296 | ACUGGCGCUUUUAUCUGAUUACUUUGAGAGCCAUCACCAGCGACUAUGUCGUAG UGGGUAAAGCUCACCUGAGGAUCACCCAGGUGAGCAUCAAAG |
| 2354 | 297 | ACUGGCGCUUUUAUCUGAUUACUUUGAGAGCCAUCACCAGCGACUAUGUCGUAG UGGGUAAAGCUCGCAUGAGGAUCACCCAUGCGAGCAUCAAAG |
| 2355 | 298 | ACUGGCGCUUUUAUCUGAUUACUUUGAGAGCCAUCACCAGCGACUAUGUCGUAG UGGGUAAAGCUCGCCUGAGGAUCACCCAGGCGAGCAUCAAAG |
| 2356 | 299 | ACUGGCGCUUUUAUCUGAUUACUUUGAGAGCCAUCACCAGCGACUAUGUCGUAG UGGGUAAAGCUCGCCUGAGCAUCAGCCAGGCGAGCAUCAAAG |
| 2357 | 300 | ACUGGCGCUUUUAUCUGAUUACUUUGAGAGCCAUCACCAGCGACUAUGUCGUAG UGGGUAAAGCUCACAUGAGCAUCAGCCAUGUGAGCAUCAAAG |
| 2358 | 301 | ACUGGCGCUUUUAUCUGAUUACUUUGAGAGCCAUCACCAGCGACUAUGUCGUAG UGGGUAAAGCUCACAUGAGUAUCAACCAUGUGAGCAUCAAAG |
| 2359 | 302 | ACUGGCGCUUUUAUCUGAUUACUUUGAGAGCCAUCACCAGCGACUAUGUCGUAG UGGGUAAAGCUCACAUGAGAAUCAGCCAUGUGAGCAUCAAAG |
| 2360 | 303 | ACUGGCGCUUUUAUCUGAUUACUUUGAGAGCCAUCACCAGCGACUAUGUCGUAG UGGGUAAAGCUCCCUUGAGGAUCACCCAUGUGAGCAUCAAAG |
| 2361 | 304 | ACUGGCGCUUUUAUCUGAUUACUUUGAGAGCCAUCACCAGCGACUAUGUCGUAG UGGGUAAAGCUCACUUGAGGAUCACCCAUGUGAGCAUCAAAG |
| 2362 | 305 | ACUGGCGCUUUUAUCUGAUUACUUUGAGAGCCAUCACCAGCGACUAUGUCGUAG UGGGUAAAGCUCACCUGAGGAUCACCCAUGUGAGCAUCAAAG |
| 2363 | 306 | ACUGGCGCUUUUAUCUGAUUACUUUGAGAGCCAUCACCAGCGACUAUGUCGUAG UGGGUAAAGCUCACAUGAGGAUCACCUAUGUGAGCAUCAAAG |
| 2364 | 307 | ACUGGCGCUUUUAUCUGAUUACUUUGAGAGCCAUCACCAGCGACUAUGUCGUAG UGGGUAAAGCUCACAUUAGGAUCACCAAUGUGAGCAUCAAAG |
| 2365 | 308 | ACUGGCGCUUUUAUCUGAUUACUUUGAGAGCCAUCACCAGCGACUAUGUCGUAG UGGGUAAAGCUCACAUUAGGAUCACCGAUGUGAGCAUCAAAG |
| 2366 | 309 | ACUGGCGCUUUUAUCUGAUUACUUUGAGAGCCAUCACCAGCGACUAUGUCGUAG UGGGUAAAGCUCACAUUAGGAUCACCUAUGUGAGCAUCAAAG |
| 2367 | 310 | ACUGGCGCUUUUAUCUGAUUACUUUGAGAGCCAUCACCAGCGACUAUGUCGUAG UGGGUAAAGCUCACAUGAGGAUUACCCAUGUGAGCAUCAAAG |
| 2368 | 311 | ACUGGCGCUUUUAUCUGAUUACUUUGAGAGCCAUCACCAGCGACUAUGUCGUAG UGGGUAAAGCUCACAUGAGGAUAACCCAUGUGAGCAUCAAAG |
| 2369 | 312 | ACUGGCGCUUUUAUCUGAUUACUUUGAGAGCCAUCACCAGCGACUAUGUCGUAG UGGGUAAAGCUCACAUGAGGAUGACCCAUGUGAGCAUCAAAG |
| 2370 | 313 | ACUGGCGCUUUUAUCUGAUUACUUUGAGAGCCAUCACCAGCGACUAUGUCGUAG UGGGUAAAGCUCACAUGAGGACCACCCAUGUGAGCAUCAAAG |

TABLE 8-continued

Exemplary gRNA Variant Scaffold Sequences

| SEQ ID NO: | Variant | NUCLEOTIDE SEQUENCE OR DESCRIPTION OF VARIANT |
|---|---|---|
| 2371 | 314 | ACUGGCGCUUUUAUCUGAUUACUUUGAGAGCCAUCACCAGCGACUAUGUCGUAG<br>UGGGUAAAGCUCAGAUGAGGAUCACCCAUGGGAGCAUCAAAG |
| 2372 | 315 | ACUGGCGCUUUUAUCUGAUUACUUUGAGAGCCAUCACCAGCGACUAUGUCGUAG<br>UGGGUAAAGCUCACAUGGGGAUCACCCAUGUGAGCAUCAAAG |
| 2376 | 320 | ACUGGGCCUUCUAUCUGAUUACUCUGAGGCCCAUCACCAGCGACUAUGUCGUAGUGGGU<br>AAAGCCGCUUAGGGACUUCGGUCCCUAAGAGGCAUCAGAG |
| 2377 | 321 | ACUGGGCCUUCUAUCUGAUUACUCUGAGGCCCAUCACCAGCGACUAUGUCGUAGUGGGU<br>AAAGCCCUUAGGGACUUCGGUCCCUAAGGGCAUCAGAG |
| 2375 | 322 | ACUGGGCCUUCUAUCUGAUUACUCUGAGGCCCAUCACCAGCGACUAUGUCGUAGUGGGU<br>AAAGCCUCUUAGGGACUUCGGUCCCUAAGAGGCAUCAGAG |
| 1959 | 323 | ACUGGGCCUUCUAUCUGAUUACUCUGAGGCCCAUCACCAGCGACUAUGUCGUAGUGGGU<br>AAAGCUCCCUCUUCGGAGGGAGCAUCAGAG |
| 1960 | 324 | ACUGGGCCUUCUAUCUGAUUACUCUGAGGCCCAUCACCAGCGACUAUGUCGUAGUGGGU<br>AAAGCCCUUAGGGACCUUGGUCCCUAAGGGCAUCAGAG |
| 1961 | 325 | ACUGGGCCUUCUAUCUGAUUACUCUGAGGCCCAUCACCAGCGACUAUGUCGUAGUGGGU<br>AAAGCCUCUUAGGGACCUUGGUCCCUAAGAGGCAUCAGAG |
| 1962 | 326 | ACUGGGCCUUCUAUCUGAUUACUCUGAGGCCCAUCACCAGCGACUAUGUCGUAGUGGGU<br>AAAGCUCCCUCCUUGGAGGGAGCAUCAGAG |
| 1963 | 327 | ACUGGGCCUUCUAUCUGAUUACUCUGAGGCCCAUCACCAGCGACUAUGUCGUAGUGGGU<br>AAAGCCCUUAGGGAGGAAACUCCCUAAGGGCAUCAGAG |
| 1964 | 328 | ACUGGGCCUUCUAUCUGAUUACUCUGAGGCCCAUCACCAGCGACUAUGUCGUAGUGGGU<br>AAAGCCUCUUAGGGAGGAAACUCCCUAAGAGGCAUCAGAG |
| 1965 | 329 | ACUGGGCCUUCUAUCUGAUUACUCUGAGGCCCAUCACCAGCGACUAUGUCGUAGUGGGU<br>AAAGCUCCCUGGAAACAGGGAGCAUCAGAG |
| 1966 | 330 | ACUGGGCCUUCUAUCUGAUUACUCUGAGGCCCAUCACCAGCGACUAUGUCGUAGUGGGU<br>AAAGCCCUUAGGGACUUCAGGUCCCUAAGGGCAUCAGAG |
| 1967 | 331 | ACUGGGCCUUCUAUCUGAUUACUCUGAGGCCCAUCACCAGCGACUAUGUCGUAGUGGGU<br>AAAGCCUCUUAGGGACUUCAGGUCCCUAAGAGGCAUCAGAG |
| 1968 | 332 | ACUGGGCCUUCUAUCUGAUUACUCUGAGGCCCAUCACCAGCGACUAUGUCGUAGUGGGU<br>AAAGCUCCCUCUUCAGGAGGGAGCAUCAGAG |
| 1969 | 333 | ACUGGGCCUUCUAUCUGAUUACUCUGAGGCCCAUCACCAGGCACUAUGUGCUAGUGGGU<br>AAAGCCCUUAGGGACCUUGGUCCCUAAGGGCAUCAGAG |
| 1970 | 334 | ACUGGGCCUUCUAUCUGAUUACUCUGAGGCCCAUCACCAGGCACUAUGUGCUAGUGGGU<br>AAAGCCUCUUAGGGACCUUGGUCCCUAAGAGGCAUCAGAG |
| 1971 | 335 | ACUGGGCCUUCUAUCUGAUUACUCUGAGGCCCAUCACCAGGCACUAUGUGCUAGUGGGU<br>AAAGCUCCCUCCUUGGAGGGAGCAUCAGAG |
| 1972 | 336 | ACUGGGCCUUCUAUCUGAUUACUCUGAGGCCCAUCACCAGGCACUAUGUGCUAGUGGGU<br>AAAGCCCUUAGGGAGGAAACUCCCUAAGGGCAUCAGAG |
| 1973 | 337 | ACUGGGCCUUCUAUCUGAUUACUCUGAGGCCCAUCACCAGGCACUAUGUGCUAGUGGGU<br>AAAGCCUCUUAGGGAGGAAACUCCCUAAGAGGCAUCAGAG |
| 1974 | 338 | ACUGGGCCUUCUAUCUGAUUACUCUGAGGCCCAUCACCAGGCACUAUGUGCUAGUGGGU<br>AAAGCUCCCUGGAAACAGGGAGCAUCAGAG |
| 1975 | 339 | ACUGGGCCUUCUAUCUGAUUACUCUGAGGCCCAUCACCAGGCACUAUGUGCUAGUGGGU<br>AAAGCCCUUAGGGACUUCAGGUCCCUAAGGGCAUCAGAG |
| 1976 | 340 | ACUGGGCCUUCUAUCUGAUUACUCUGAGGCCCAUCACCAGGCACUAUGUGCUAGUGGGU<br>AAAGCCUCUUAGGGACUUCAGGUCCCUAAGAGGCAUCAGAG |
| 1977 | 341 | ACUGGGCCUUCUAUCUGAUUACUCUGAGGCCCAUCACCAGGCACUAUGUGCUAGUGGGU<br>AAAGCUCCCUCUUCAGGAGGGAGCAUCAGAG |
| 1978 | 343 | ACUGGCGCUUCUAUCUGAUUACUCUGAGCGCCAUCACCAGCGACUAUGUCGUAGUGGGU<br>AAAGCUCACAUGAGGAUCACCCAUGUGAGCAUCAGAG |

TABLE 8-continued

Exemplary gRNA Variant Scaffold Sequences

| SEQ ID NO: | Variant | NUCLEOTIDE SEQUENCE OR DESCRIPTION OF VARIANT |
|---|---|---|
| 1979 | 344 | ACUGGCGCUUCUAUCUGAUUACUCUGAGCGCCAUCACCAGCGACUAUGUCGUAGUGGGU AAAGCUGCACUAUGGGCGCAGCGUCAAUGACGCUGACGGUACAGGCCACAUGAGGAUCA CCCAUGUGGUAUAGUGCAGCAUCAGAG |
| 1980 | 345 | ACUGGCGCUUCUAUCUGAUUACUCUGAGCGCCAUCACCAGCGACUAUGUCGUAGUGGGU AAAGCUGCACUAUGGGCGCAGCUCAUGAGGAUCACCCAUGAGCUGACGGUACAGGCCAC AUGAGGAUCACCCAUGUGGUAUAGUGCAGCAUCAGAG |
| 1981 | 346 | ACUGGCGCUUCUAUCUGAUUACUCUGAGCGCCAUCACCAGCGACUAUGUCGUAGUGGGU AAAGCUGCACUAUGGGCGCAGACAUGGCAGUCGUAACGACGCGGGUCUGACGGUACAGG CCACAUGAGGAUCACCCAUGUGGUAUAGUGCAGCAUCAGAG |
| 1982 | 347 | ACUGGCGCUUUUAUCUGAUUACUUUGAGAGCCAUCACCAGCGACUAUGUCGUAGUGGGU AAAGCUGCACUAUGGGGCCACAUGAGGAUCACCCAUGUGGUGUACAGCGCAGCGUCAAU GACGCUGACGAUAGUGCAGCAUCAAAG |
| 1983 | 348 | ACUGGCGCUUUUAUCUGAUUACUUUGAGAGCCAUCACCAGCGACUAUGUCGUAGUGGGU AAAGCUGCACUAUGGGCGCAGCUCAUGAGGAUCACCCAUGAGCUGACGGUACAGGCCAC AUGAGGAUCACCCAUGUGGUAUAGUGCAGCAUCAAAGCUGCAUUCUAGUUGUGGUUUCA CAAUUAUUCUUGAGUGUAGUCUCGUCAUUCACCAAAUCUUUGUUUGGUGCGCGCGGCCG GCAUGGUCCCAGCCUCCUCGCUGGCGCCGGCUGGGCAACAUUCCGAGGGGACCGUCCCC UCGGUAAUGGCGAAUGGGACGUCGACUGCUAACAAAGCCCGAAAGGAAGCUGAGUUGGC UGCUGCCACCGCUGAGCAAUAACUAGCAUAACCCCUUGGGGCCUCUAAACGGGUCUUGA GGGGUUUUUUGCUGAUUUUUUUU |
| 1984 | 349 | ACUGGCGCUUUUAUCUGAUUACUUUGAGAGCCAUCACCAGCGACUAUGUCGUAGUGGGU AAAGCUGCACUAUGGGCGCAGCUCAUGAGGAUCACCCAUGAGCUGACGGUACAGGCCAC AUGAGGAUCACCCAUGUGGUAUAGUGCAGCAUCAAAGCUGCAUUCUAGUUGUGGUUUAU GGCCGGCAUGGUCCCAGCCUCCUCGCUGGCGCCGGCUGGGCAACAUUCCGAGGGGACCG CCCCCUCGGUAAUGGCGAAUGGGACCCAUUUUUUUU |
| 1985 | 350 | ACUGGCGCUUUUAUCUGAUUACUUUGAGAGCCAUCACCAGCGACUAUGUCGUAGUGGGU AAAGCUGCACUAUGGGCGCAGCUCAUGAGGAUCACCCAUGAGCUGACGGUACAGGCCAC AUGAGGAUCACCCAUGUGGUAUAGUGCAGCAUCAAAGCUGCAUUCUAGUUGUGGUUUGU GGCCGGCAUGGUCCAGCCUACUCGCUGGCGCGGGCUGGGCAACAUUCCGAGGGGACCCG UCCCUCGGUAAUGGCGAAUGGGACCCAUUUUUUUU |
| 1986 | 351 | ACUGGCGCUUUUAUCUGAUUACUUUGAGAGCCAUCACCAGCGACUAUGUCGUAGUGGGU AAAGCUGCACUAUGGGCGCAGCUCAUGAGGAUCACCCAUGAGCUGACGGUACAGGCCAC AUGAGGAUCACCCAUGUGGUAUAGUGCAGCAUCAAAGCUGCAUUCUAGUUGUGGUUUGU GGCCGGCAUGGCCCCAGCCUCCUCGCUGGCGCCGGCUGGGCAACGAUCCGAGGGGACUG UCCCUCUCGAGAAUCGGCAAAUGGGGCCCCUUUUUUUU |
| 1987 | 352 | ACUGGCGCUUUUAUCUGAUUACUUUGAGAGCCAUCACCAGCGACUAUGUCGUAGUGGGU AAAGCUGCACUAUGGGCGCAGCUCAUGAGGAUCACCCAUGAGCUGACGGUACAGGCCAC AUGAGGAUCACCCAUGUGGUAUAGUGCAGCAUCAAAGCUGCAUUCUAGUUGUGGUUUUC GGGUCGGCAUGGCAUCUCCACCUCCACCUCCGCGGUCCGACCUGGGCAUCCGAAGGA GGAGCGGACGUCCACUCGGAUGGCUAAGGGAGAGCCCAGUUUUUUUU |
| 1988 | 353 | ACUGGCGCUUUUAUCUGAUUACUUUGAGAGCCAUCACCAGCGACUAUGUCGUAGUGGGU AAAGCUGCACUAUGGGCGCAGCUCAUGAGGAUCACCCAUGAGCUGACGGUACAGGCCAC AUGAGGAUCACCCAUGUGGUAUAGUGCAGCAUCAAAGCUGCAUUCUAGUUGUGGUUUUC GGGUCGGCAUGGCAUCUCCACCUCCCCGUGGUCCGACCUGGGCAUCCGAAGGAGGACGG ACGUCCACUCGGAUGGCUAAGGGAGUGCCGGCUUUUUUUU |
| 1989 | 354 | ACUGGCGCUUUUAUCUGAUUACUUUGAGAGCCAUCACCAGCGACUAUGUCGUAGUGGGU AAAGCUGCACUAUGGGCGCAGCUCAUGAGGAUCACCCAUGAGCUGACGGUACAGGCCAC AUGAGGAUCACCCAUGUGGUAUAGUGCAGCAUCAAAGCUGCAUUCUAGUUGUGGUUUGG CCGGCAUGGUCCCAGCCUCCUCGCUGGCGCCGGCUGGGCAACAUGCUUCGGCAUGGCGA AUGGGACUUUUUUUU |
| 1990 | 355 | ACUGGCGCUUUUAUCUGAUUACUUUGAGAGCCAUCACCAGCGACUAUGUCGUAGUGGGU AAAGCUCACAUGAGGAUCACCCAUGUGAGCAUCAAAGCUGCAUUCUAGUUGUGGUUUCA CAAUUAUUCUUGAGUGUAGUCUCGUCAUUCACCAAAUCUUUGUUUGGUGCGCGCGGCCG GCAUGGUCCCAGCCUCCUCGCUGGCGCCGGCUGGGCAACAUUCCGAGGGGACCGUCCCC UCGGUAAUGGCGAAUGGGACGUCGACUGCUAACAAAGCCCGAAAGGAAGCUGAGUUGGC UGCUGCCACCGCUGAGCAAUAACUAGCAUAACCCCUUGGGGCCUCUAAACGGGUCUUGA GGGGUUUUUUGCUGAUUUUUUUU |
| 1991 | 356 | ACUGGCGCUUUUAUCUGAUUACUUUGAGAGCCAUCACCAGCGACUAUGUCGUAGUGGGU AAAGCUCACAUGAGGAUCACCCAUGUGAGCAUCAAAGCUGCAUUCUAGUUGUGGUUUAU GGCCGGCAUGGUCCCAGCCUCCUCGCUGGCGCCGGCUGGGCAACAUUCCGAGGGGACCG CCCCCUCGGUAAUGGCGAAUGGGACCCAUUUUUUUU |

TABLE 8-continued

Exemplary gRNA Variant Scaffold Sequences

| SEQ ID NO: | Variant | NUCLEOTIDE SEQUENCE OR DESCRIPTION OF VARIANT |
|---|---|---|
| 1992 | 357 | ACUGGCGCUUUUAUCUGAUUACUUUGAGAGCCAUCACCAGCGACUAUGUCGUAGUGGGU<br>AAAGCUCACAUGAGGAUCACCCAUGUGAGCAUCAAAGCUGCAUUCUAGUUGUGGUUUGU<br>GGCCGGCAUGGUCCAGCCUACUCGCUGGCGCGGGCUGGGCAACAUUCCGAGGGGACCCG<br>UCCCUCGGUAAUGGCGAAUGGGACCCAUUUUUUUU |
| 1993 | 358 | ACUGGCGCUUUUAUCUGAUUACUUUGAGAGCCAUCACCAGCGACUAUGUCGUAGUGGGU<br>AAAGCUCACAUGAGGAUCACCCAUGUGAGCAUCAAAGCUGCAUUCUAGUUGUGGUUUGU<br>GGCCGGCAUGGCCCCAGCCUCCUCGCUGGCGCCGGCUGGGCAACGAUCCGAGGGGACUG<br>UCCCUCUCGAGAAUCGGCAAAUGGGGCCCCUUUUUUUU |
| 1994 | 359 | ACUGGCGCUUUUAUCUGAUUACUUUGAGAGCCAUCACCAGCGACUAUGUCGUAGUGGGU<br>AAAGCUCACAUGAGGAUCACCCAUGUGAGCAUCAAAGCUGCAUUCUAGUUGUGGUUUUC<br>GGGUCGGCAUGGCAUCUCCACCUCCACCUCCUCGCGGUCCGACCUGGGCAUCCGAAGGA<br>GGAGCGGACGUCCACUCGGAUGGCUAAGGGAGAGCCCAGUUUUUUUU |
| 1995 | 360 | ACUGGCGCUUUUAUCUGAUUACUUUGAGAGCCAUCACCAGCGACUAUGUCGUAGUGGGU<br>AAAGCUCACAUGAGGAUCACCCAUGUGAGCAUCAAAGCUGCAUUCUAGUUGUGGUUUUC<br>GGGUCGGCAUGGCAUCUCCACCUCCCCGUGGUCCGACCUGGGCAUCCGAAGGAGGACGG<br>ACGUCCACUCGGAUGGCUAAGGGAGUGCCGGCUUUUUUUU |
| 1996 | 361 | ACUGGCGCUUUUAUCUGAUUACUUUGAGAGCCAUCACCAGCGACUAUGUCGUAGUGGGU<br>AAAGCUCACAUGAGGAUCACCCAUGUGAGCAUCAAAGCUGCAUUCUAGUUGUGGUUUGG<br>CCGGCAUGGUCCCAGCCUCCUCGCUGGCGCCGGCUGGGCAACAUGCUUCGGCAUGGCGA<br>AUGGGACUUUUUUUU |
| 1997 | 362 | ACUGGCGCUUUUAUCUGAUUACUUUGAGAGCCAUCACCAGCGACUAUGUCGUAGUGGGU<br>AAAGCUGCACUAUGGGCGCAGCAAGGAGUUUAUAUGGAAACCCUUGCUGACGGUACAGG<br>CCAAGGAGUUUAUAUGGAAACCCUUGGUAUAGUGCAGCAUCAAAG |
| 1998 | 363 | ACUGGCGCUUUUAUCUGAUUACUUUGAGAGCCAUCACCAGCGACUAUGUCGUAGUGGGU<br>AAAGCUGCACUAUGGGCGCAGCGCCCUGAAGAAGGGCGCUGACGGUACAGGCCGCCCUG<br>AAGAAGGGCGGUAUAGUGCAGCAUCAAAG |
| 1999 | 364 | ACUGGCGCUUUUAUCUGAUUACUUUGAGAGCCAUCACCAGCGACUAUGUCGUAGUGGGU<br>AAAGCUGCACUAUGGGCGCAGCGGCUCGUGUAGCUCAUUAGCUCCGAGCCGCUGACGGU<br>ACAGGCCGGCUCGUGUAGCUCAUUAGCUCCGAGCCGGUAUAGUGCAGCAUCAAAG |
| 2000 | 365 | ACUGGCGCUUUUAUCUGAUUACUUUGAGAGCCAUCACCAGCGACUAUGUCGUAGUGGGU<br>AAAGCUGCACUAUGGGCGCAGCCCGUGUGCAUCCGCAGUGUCGGAUCCACGGGCUGACG<br>GUACAGGCCCCGUGUGCAUCCGCAGUGUCGGAUCCACGGGGUAUAGUGCAGCAUCAAAG |
| 2001 | 366 | ACUGGCGCUUUUAUCUGAUUACUUUGAGAGCCAUCACCAGCGACUAUGUCGUAGUGGGU<br>AAAGCUGCACUAUGGGCGCAGCAUCCAUUGCACUCCGGAUAGCUGCUGACGGUACAGGC<br>CAUCCAUUGCACUCCGGAUAGCUGGUAUAGUGCAGCAUCAAAG |
| 2002 | 367 | ACUGGCGCUUUUAUCUGAUUACUUUGAGAGCCAUCACCAGCGACUAUGUCGUAGUGGGU<br>AAAGCUGCACUAUGGGCGCAGCAUGCAUGUCUAAGACAGCAUGCUGACGGUACAGGCCA<br>UGCAUGUCUAAGACAGCAUGGUAUAGUGCAGCAUCAAAG |
| 2003 | 368 | ACUGGCGCUUUUAUCUGAUUACUUUGAGAGCCAUCACCAGCGACUAUGUCGUAGUGGGU<br>AAAGCUGCACUAUGGGCGCAGCAAAACAUAAGGAAAACCUAUGUUCUGACGGUACAGGC<br>CAAAACAUAAGGAAAACCUAUGUUGGUAUAGUGCAGCAUCAAAG |
| 2004 | 369 | ACUGGCGCUUCUAUCUGAUUACUCUGAGCGCCAUCACCAGCGACUAUGUCGUAGUGGGU<br>AAAGCCGCUUACGGACUAUGGGCGCAGCAAGGAGUUUAUAUGGAAACCCUUGCUGACGG<br>UACAGGCCAAGGAGUUUAUAUGGAAACCCUUGGUAUAGUCCGUAAGAGGCAUCAGAG |
| 2005 | 370 | ACUGGCGCUUCUAUCUGAUUACUCUGAGCGCCAUCACCAGCGACUAUGUCGUAGUGGGU<br>AAAGCCGCUUACGGACUAUGGGCGCAGCGCCCUGAAGAAGGGCGCUGACGGUACAGGCC<br>GCCCUGAAGAAGGGCGGUAUAGUCCGUAAGAGGCAUCAGAG |
| 2006 | 371 | ACUGGCGCUUCUAUCUGAUUACUCUGAGCGCCAUCACCAGCGACUAUGUCGUAGUGGGU<br>AAAGCCGCUUACGGACUAUGGGCGCAGCGGCUCGUGUAGCUCAUUAGCUCCGAGCCGCU<br>GACGGUACAGGCCGGCUCGUGUAGCUCAUUAGCUCCGAGCCGGUAUAGUCCGUAAGAGG<br>CAUCAGAG |
| 2007 | 372 | ACUGGCGCUUCUAUCUGAUUACUCUGAGCGCCAUCACCAGCGACUAUGUCGUAGUGGGU<br>AAAGCCGCUUACGGACUAUGGGCGCAGCCCGUGUGCAUCCGCAGUGUCGGAUCCACGGG<br>CUGACGGUACAGGCCCCGUGUGCAUCCGCAGUGUCGGAUCCACGGGGUAUAGUCCGUAA<br>GAGGCAUCAGAG |
| 2008 | 373 | ACUGGCGCUUCUAUCUGAUUACUCUGAGCGCCAUCACCAGCGACUAUGUCGUAGUGGGU<br>AAAGCCGCUUACGGACUAUGGGCGCAGCAUCCAUUGCACUCCGGAUAGCUGCUGACGGU<br>ACAGGCCAUCCAUUGCACUCCGGAUAGCUGGUAUAGUCCGUAAGAGGCAUCAGAG |

TABLE 8-continued

Exemplary gRNA Variant Scaffold Sequences

| SEQ ID NO: | Variant | NUCLEOTIDE SEQUENCE OR DESCRIPTION OF VARIANT |
|---|---|---|
| 2009 | 374 | ACUGGCGCUUCUAUCUGAUUACUCUGAGCGCCAUCACCAGCGACUAUGUCGUAGUGGGU AAAGCCGCUUACGGACUAUGGGCGCAGCAUGCAUGUCUAAGACAGCAUGCUGACGGUAC AGGCCAUGCAUGUCUAAGACAGCAUGGUAUAGUCCGUAAGAGGCAUCAGAG |
| 2010 | 375 | ACUGGCGCUUCUAUCUGAUUACUCUGAGCGCCAUCACCAGCGACUAUGUCGUAGUGGGU AAAGCCGCUUACGGACUAUGGGCGCAGCAAAACAUAAGGAAAACCUAUGUUGCUGACGG UACAGGCCAAAACAUAAGGAAAACCUAUGUUGGUAUAGUCCGUAAGAGGCAUCAGAG |

Additional sgRNA variants are presented in the attached sequence listing, as SEQ ID NOS: 2101-2237.

In some embodiments, a sgRNA variant comprises one or more additional changes to a sequence of SEQ ID NO:2238, SEQ ID NO:2239, SEQ ID NO:2240, SEQ ID NO:2241, SEQ ID NO:2243, SEQ ID NO:2256, SEQ ID NO:2274, SEQ ID NO:2275, SEQ ID NO:2279, SEQ ID NO:2281, SEQ ID NO: 2285, SEQ ID NO: 2289, SEQ ID NO: 2292, or SEQ ID NO: 2308 of Table 8.

h. Transport of CRISPR Components by Non-Covalent Recruitment: gRNA Binding Partners and Packaging Elements In some embodiments of the XDP system, gRNA variants comprise additional domains that facilitate the transport of the gRNA, and any CasX variant complexed with the gRNA variant, out of the nucleus and, when CasX complexes to the gRNA variant as an RNP, facilitates the non-covalent recruitment of the gRNA and complexed CasX to the budding XDP, thereby enhancing the ability of the packaging host cell to package the RNP into the XDP. In some embodiments, the gRNA-encoding plasmid comprises a sequence of one or more RRE or components of an RRE, described below, incorporated into the extended stem region of the gRNA. The term "Rev response element" or "RRE" refers to a cis-acting post-transcriptional regulatory element that, in the context of retroviral reproduction, serves as a specific RNA scaffold that coordinates the assembly of a unique homo-oligomeric ribonucleoprotein (RNP) complex to mediate the nuclear export of essential, intron-containing, viral messages. It has been discovered, however that incorporation of certain RNA sequences capable of binding an HIV Rev protein onto the gRNA facilitates the export of an expressed gRNA of the XDP system from the nucleus by interaction with multiple molecules of Rev, across the nuclear membrane, to the cytoplasm of a cell. Examples of RNA binding partners include, but are not limited to, the human immunodeficiency virus (HIV) rev response element (RRE) (see e.g., Cullen et al. (1991) J. Virol. 65: 1053; and Cullen et al. (1991) Cell 58: 423-426), the constitutive transport element (CTE) of the simian retrovirus (Giulietti, M., et al. ExportAid: database of RNA elements regulating nuclear RNA export in mammals. Bioinformatics 31:246 (2015)), the hepatitis B virus post-transcriptional regulatory element (PTRE) (see e.g., Huang et al. (1995) Molec. and Cell. Biol. 15(7): 3864-3869; Huang et al. (1994) J. Virol. 68(5): 3193-3199; Huang et al. (1993) Molec. and Cell. Biol 13(12): 7476-7486), and U.S. Pat. No. 5,744,326, and heterogeneous nuclear ribonucleoparticle protein (hnRNP)(Lei, E. et al. Protein and RNA Export from the Nucleus. Develop. Cell 2:261 (2002)), which are all hereby incorporated by reference). In some embodiments of the XDP system, the nucleic acid encoding the guide RNA variants comprises one or more NES components selected from the group consisting of Stem IIB of Rev response element (RRE), Stem II-V of RRE, Stem II of RRE, Rev-binding element (RBE) of Stem IIB, and full-length RRE. In the foregoing embodiment, the components include sequences of UGGGCGCAGCGU-CAAUGACGCUGACGGUACA (Stem IIB, SEQ ID NO: 569), GCACUAUGGGCGCAGCGU-CAAUGACGCUGACGGUACAGGCCA-GACAAUUAUUGUCU GGUAUAGUGC (Stem II, SEQ ID NO: 570), GCUGACGGUACAGGC (RBE, SEQ ID NO: 2378), CAGGAAGCACUAUGGGCGCAGCGU-CAAUGACGCUGACGGUACAGGCCAGACAAUUA UUGUCUG-GUAUAGUGCAGCAGCAGAACAAUUUGCUGAGG GCUAUUGAGGCGCAACA GCAUCUGUUGCAACU-CACAGUCUGGGGCAUCAAGCAGCUCCAGGCAAG AAUCCUG (Stem II-V, SEQ ID NO: 571), and AGGAGC-UUUGUUCCUUGGGUUCUUGGGAGCAGCAG-GAAGCACUAUGGGCGCAGCGU CAAUGACGCUGACGGUACAGGCCA-GACAAUUAUUGUCUGGUAUAGUGCAGCAGCAG AACAAUUUGCUGAGGGCUAUUGAGGCGCAACAG-CAUCUGUUGCAACUCACAGUCUG GGGCAU-CAAGCAGCUCCAGGCAAGAAUCCUGGCUGUG-GAAAGAUACCUAAAGGAUC AACAGCUCCU (full-length RRE, SEQ ID NO: 572). In some embodiments, the gRNA variant comprises one RRE component selected from RBE, Stem IIB, Stem II-V, Stem II, and full-length RRE, wherein the RRE component is incorporated in the extended stem of the guide RNA. In other embodiments, the gRNA variant comprises two RRE components selected from RBE, Stem IIB, Stem II-V, Stem II, and full-length RRE, which may be identical or may be different, wherein the RRE component is incorporated in the extended stem of the guide RNA. In other embodiments, the gRNA variant comprises three RRE components selected from RBE, Stem IIB, Stem II-V, Stem II, and full-length RRE, which may be identical or may be different, wherein the RRE component is incorporated in the extended stem of the guide RNA. In other embodiments, the gRNA variant comprises four RRE components selected from RBE, Stem IIB, Stem II-V, Stem II, and full-length RRE, which may be identical or may be different, wherein the RRE component is incorporated in the extended stem of the guide RNA. In some embodiments, the disclosure provides gRNA variants comprising a Rev-binding element (RBE) of Stem IIB, depicted in FIG. 75. In other embodiments, the disclosure provides gRNA variants comprising two or more (e.g., 2, 3, 4, 5 or more) RBE as concatenates in the extended stem of the gRNA of the XDP system. In the foregoing embodiments, a sequence encoding lentiviral Rev protein can be incorporated into any of the nucleic acids of the XDP system, but in a particular embodiment, is incorporated into a nucleic acid comprising the Gag polyprotein or a plasmid encoding a Gag component such that upon expression, the Rev can bind with the RRE or RBE elements of the gRNA variant and, as a nuclear export signal (NES), facilitate the transport of the guide RNA out of the nucleus. In other cases, the gRNA variant comprising the RRE component(s) facilitates the transport of the CasX:gRNA RNP complex out of the nucleus when the CasX variant has bound the gRNA variant. Non-limiting representative gRNA sequences comprising RBE include gRNA scaffolds 226, 243, 249-254, 256 and 264 of Table 8, corresponding to SEQ ID NOS: 2380, 2300, 2306-2311, 2313 and 2312, respectively. It will be further appreciated that the inclusion of the RBE or RRE in the gRNA variant serves to counteract the effects of the NLS incorporated into CasX variant of the RNP that "drives" entry of the CasX variants into the nucleus, thereby contributing to the ability of the packaging host cell to package the RNP into the XDP. In other embodiments, the gRNA variant can comprise one or more RBE or RRE and one or more packaging sequences wherein the XDP comprises a Rev element and an NCR protein fused to the Gag polyprotein such that the gRNA variant has enhanced affinity for both these ligands and exhibits improved nuclear export as well as non-covalent recruitment and incorporation for the CasX:gRNA complex into the budding XDP in the producing host cell. In some embodiments, the gRNA variant comprises one or more binding partner elements to facilitate the non-covalent recruitment of the gRNA variant and any associated CasX variant into the budding XDP in the packaging host cell, wherein the ligand of the RNA binding partner is fused to the Gag component incorporated into the XDP. The RNA binding partner can be a retroviral psi packaging element inserted into the gRNA variant or is a hairpin stem loop such as MS2 hairpin, PP7 hairpin, Qβ hairpin, boxB, phage GA hairpin, phage ΛN hairpin, iron response element (IRE), transactivation response element (TAR), or U1 hairpin II with affinity to expressed NCR protein linked to Gag (or components of Gag) selected from the group consisting of MS2 coat protein, PP7 coat protein, Qβ coat protein, protein N, protein Tat, phage GA coat protein, iron-responsive binding element (IRE) protein, or U1A signal recognition particle protein (U1A), which, upon the interaction of the binding partner and the NCR protein, can facilitate the non-covalent recruitment and incorporation of the gRNA variant (and CasX variant that complexes to the gRNA) into the budding XDP in the packaging host cell. As used herein, "binding partner" means a sequence of the gRNA that has binding affinity to a packaging recruiter, while "packaging recruiter" means a peptide or protein that, when expressed in the packaging host cell, facilitates the non-covalent recruitment and incorporation of the gRNA variant and associated CasX variant into the budding XDP in the packaging host cell. It has been discovered that the incorporation of the binding partner inserted into the guide RNA and the packaging recruiter into the nucleic acid comprising the Gag polypeptide facilitates the packaging of the XDP particle due, in part, to the affinity of the CasX for the gRNA, resulting in an RNP, such that both the gRNA variant and CasX variant are associated with Gag during the encapsidation process of the XDP, increasing the proportion of XDP comprising RNP compared to a construct lacking the binding partner and packaging recruiter. In embodiments in which two different RNPs are incorporated in the XDP, the nucleic acids encoding both the first and second gRNA variants would incorporate the binding partner element to facilitate the packaging of the two RNA into the XDP during the encapsidation process. In some embodiments, a single plasmid would comprise the nucleic acid for both the first and second gRNA variants. In other embodiments, separate plasmids would be utilized for the nucleic acid for the first and second gRNA variants. In some embodiments, the gRNA scaffolds comprising binding partner elements are selected from the group of sequences consisting of SEQ ID NOS: 1978-1996, 2249, 2307, 2308, 2311, 2323-2325, 2330-2336, 2340, 2343, 2349, 2352-2357, 2361, 2364, 2370, and 2373-2377.

In some embodiments, the disclosure provides XDP in which the binding partner element and the packaging component are encoded in their respective plasmids in a 1:1 ratio (protein to gRNA). In other embodiments, the disclosure provides XDP in which the binding partner element and the packaging component are encoded in their respective plasmids in a 1:2 ratio (protein to gRNA). In other embodiments, the disclosure provides XDP in which the binding partner element and the packaging component are encoded in their respective plasmids in a 1:3 ratio (protein to gRNA). In other embodiments, the disclosure provides XDP in which the binding partner element and the packaging component are encoded in their respective plasmids in a 1:4 ratio (protein to gRNA). In other embodiments, the disclosure provides XDP in which the binding partner element and the packaging component are encoded in their respective plasmids in a 1:5 ratio (protein to gRNA). In some embodiments, the incorporation of the binding partner(s) and packaging recruiter(s) results in enhanced incorporation of the RNP of the CRISPR nuclease and gRNA into the XDP compared to a system not comprising the binding partner(s) and packaging recruiter(s). In some embodiments, the incorporation of the binding partner(s) and packaging recruiter(s) results in XDP containing at least about 100, at least about 200, at least about 300, at least about 400, at least about 500, at least about 600, at least about 700, at least about 800, at least about 900, or at least about 1000 molecules of the RNP of the CRISPR nuclease and gRNA. In a particular embodiment, the incorporation of the binding partner(s) and packaging recruiter(s) results in XDP containing at least about 100, at least about 200, at least about 300, at least about 400, at least about 500, at least about 600, at least about 700, at least about 800, at least about 900, or at least about 1000 molecules of an RNP of a CasX variant and gRNA variant of an embodiment described herein. In some embodiments, the incorporation of the binding partner(s) and packaging recruiter(s) results in XDP containing at least about 100 to about 1000 RNP, at least about 200 to about 800 RNP, or at least about 300 to about 600 RNP. In some embodiments, the incorporation of the binding partner(s) and packaging recruiter(s) results in at least a 2-fold, at a least 3-fold, or at least a 4-fold increase in editing potency of the XDP for a target nucleic acid compared to XDP without the incorporated binding partner(s) and packaging recruiter(s), when assessed in an in vitro assay under comparable conditions.

i. MS2 Hairpin Variants

As described, supra, the gRNA variant can be modified to comprise one or more binding partner elements to facilitate the non-covalent recruitment of the gRNA variant and the associated CasX variant into the budding XDP in the packaging host cell. One such binding partner element is an MS2 hairpin (for example, an MS2 hairpin encoded by any one of SEQ ID NOS: 1846-1854), incorporated into the extended stem of the gRNA scaffold, which has affinity to its ligand, MS2 coat protein. As described in embodiments herein, XDP have been designed with the MS2 coat protein linked to the Gag polyprotein and MS2 hairpins incorporated into the gRNA variant to facilitate the non-covalent recruitment and incorporation of the CasX:gRNA complex into the XDP particles. It has been discovered, as described in the Examples, that modifying the sequence of the MS2 hairpin to increase the binding affinity of the MS2 hairpin for its ligand enhances the editing activity of the resulting XDP towards the target nucleic acid when introduced into target cells. In some embodiments, the disclosure provides XDP comprising gRNA variants comprising one or more MS2 hairpin sequence variants, wherein the variant exhibits a $K_D$ to its ligand of less than 100 nM, less than 50 nM, less than 35 nM, less than 10 nM, less than 3 nM, or less than 2 nM. In some embodiments, the disclosure provides XDP comprising a CasX variant and a gRNA variant comprising one or more MS2 hairpin sequence variants, wherein the variant exhibits a $K_D$ to its ligand of less than 100 nM, less than 50 nM, less than 35 nM, less than 10 nM, less than 3 nM, or less than 2 nM and wherein the resulting XDP exhibits improved editing activity towards a target nucleic acid in an in vitro cellular assay, wherein the $EC_{50}$ is less than $10^8$, or less than $10^7$, or less than $10^6$ particles to achieve editing in 50% of the cells. In a particular embodiment, the disclosure provides XDP comprising a gRNA variant comprising one or more MS2 hairpin sequence variants exhibiting a $K_D$ to its ligand of less than 10 nM, wherein the XDP exhibits editing activity towards a target nucleic acid in an in vitro cellular assay wherein the $EC_{50}$ is less than $10^7$ or $10^6$ particles. In some embodiments, the XDP comprises a gRNA variant comprising one or more MS2 hairpin sequence variants wherein the scaffold is selected from the group consisting of gRNA scaffold variants 188, 251, 296-315, corresponding to SEQ ID NOS: 2249, 2308 and 2353-2372. In a particular embodiment, the XDP comprises a gRNA variant comprising one or more MS2 hairpin sequence variants wherein the scaffold is selected from the group consisting of gRNA variants 188, 251, 296-300, 304, 305, 307 and 313, corresponding to SEQ ID NOS: 2249, 2308, 2353-2357, 2361, 2362, 2364 and 2370.

V. TROPISM FACTORS AND PSEUDOTYPING OF XDP SYSTEMS

In another aspect, the disclosure relates to the incorporation of tropism factors in the XDP to increase tropism and selectivity for target cells, organ, or tissues intended for gene editing or repression. Tropism factors of the XDP embodiments include, but are not limited to, envelope glycoproteins derived from viruses, antibody fragments, and receptors or ligands that have binding affinity to target cell markers. The inclusion of such tropism factors on the surface of XDP particles enhances the ability of the XDP to selectively target, bind to, and fuse with the cell membrane of a target cell, tissue or organ bearing such target cell markers, increasing the therapeutic index and reducing unintended side effects of the therapeutic payload incorporated into the XDP. Exemplary target cells include T cells, B cells, macrophages, liquid cancer cells (such as leukemia or myeloma cells), solid tumor cells, muscle cells, epithelial cells, endothelial cells, stem cells, dendritic cells, retinal cells, hepatic cells, cardiac cells, thyroid cells, neurons, glial cells, oligodendrocytes, Schwann cells, and pancreatic cells. Exemplary target organs include the brain, heart, liver, pancreas, lung, eye, stomach, small intestine, colon, and kidney. Exemplary tissues include skin, muscle, bone, epithelial, and connective tissue.

In some embodiments, the XDP comprises one or more glycoproteins (GP) incorporated on the surface of the particle wherein the GP provides for enhanced or selective binding and fusion of the XDP to a cell-surface marker of a target cell to be modified. In other embodiments, the XDP comprises one or more antibody fragments on the surface of the particle wherein the antibody fragments provides for enhanced or selective binding and fusion of the XDP to a cell-surface marker of a target cell. In other embodiments, the XDP comprises one or more cell surface receptors, including G-protein-linked receptors, and enzyme-linked receptors, on the surface of the particle wherein the receptor provides for enhanced or selective binding and fusion of the XDP to a cell-surface marker of a target cell. In some embodiments, the XDP comprises one or more ligands on the surface of the particle wherein the ligand provides for enhanced or selective binding and fusion of the XDP to a target cell bearing a receptor to the ligand on the cell surface. In still other embodiments, the XDP comprises a combination of one or more glycoproteins, antibody fragments, cell receptors, or ligands on the surface of the particle to provide for enhanced or selective binding and fusion of the XDP to a target cell.

For enveloped viruses, membrane fusion for viral entry is mediated by membrane glycoprotein complexes. Two basic mechanistic principles of membrane fusion have emerged as conserved among enveloped viruses; target membrane engagement and refolding into hairpin-like structures (Plemper, R K. Cell Entry of Enveloped Viruses. Curr Opin Virol. 1:92 (2011)). The envelope glycoproteins are typically observed as characteristic protein "spikes" on the surface of purified virions in electron microscopic images. The underlying mechanism of viral entry by enveloped viruses can be utilized to preferentially direct XDP to target particular cells, organs, or tissues in a process known as pseudotyping. In some embodiments, the XDP of the disclosure are pseudotyped by incorporation of a glycoprotein derived from an enveloped virus that has a demonstrated tropism for a particular organ, tissue or cell. Representative glycoproteins within the scope of the instant disclosure are listed in Table 9, and in the Examples. In some embodiments, the viruses used to provide the glycoprotein include, but are not limited to Argentine hemorrhagic fever virus, Australian bat virus, *Autographa californica* multiple nucleopolyhedrovirus, Avian leukosis virus, baboon endogenous virus, Bolivian hemorrhagic fever virus, Borna disease virus, Breda virus, Bunyamwera virus, Chandipura virus, Chikungunya virus, Crimean-Congo hemorrhagic fever virus, Dengue fever virus, Duvenhage virus, Eastern equine encephalitis virus, Ebola hemorrhagic fever virus, Ebola Zaire virus, enteric adenovirus, Ephemerovirus, Epstein-Bar virus (EBV), European bat virus 1, European bat virus 2, Fug Synthetic gP Fusion, Gibbon ape leukemia virus, Hantavirus, Hendra virus, hepatitis A virus, hepatitis B virus, hepatitis C virus, hepatitis D virus, hepatitis E virus, hepatitis G Virus (GB virus C), herpes simplex virus type 1, herpes simplex virus type 2, human cytomegalovirus (HHV5), human foamy virus, human herpesvirus (HHV), human Herpesvirus 7, human herpesvirus type 6, human herpesvirus type 8, human immunodeficiency virus 1 (HIV-1), human metapneumovirus, human T-lymphotropic virus 1, influenza A, influenza B, influenza C virus, Japanese encephalitis virus, Kaposi's sarcoma-associated herpesvirus (HHV8), Kaysanur Forest disease virus, La Crosse virus, Lagos bat virus, Lassa fever virus, lymphocytic choriomeningitis virus (LCMV), Machupo virus, Marburg hemorrhagic fever virus, measles virus, Middle eastern respiratory syndrome-related coronavirus, Mokola virus, Moloney murine leukemia virus, monkey pox, mouse mammary tumor virus, mumps virus, murine gammaherpesvirus, Newcastle disease virus, Nipah virus, Nipah virus, Norwalk virus, Omsk hemorrhagic fever virus, papilloma virus, parvovirus, pseudorabies virus, Quaranfil virus, rabies virus, RD114 Endogenous Feline Retrovirus, respiratory syncytial virus (RSV), Rift Valley fever virus, Ross River virus, rRotavirus, Rous sarcoma virus, rubella virus, Sabia-associated hemorrhagic fever virus, SARS-associated coronavirus (SARS-CoV), Sendai virus, Tacaribe virus, Thogotovirus, tick-borne encephalitis causing virus, varicella zoster virus (HHV3), varicella zoster virus (HHV3), variola major virus, variola minor virus, Venezuelan equine encephalitis virus, Venezuelan hemorrhagic fever virus, vesicular stomatitis virus (VSV), Vesiculovirus, West Nile virus, western equine encephalitis virus, and Zika Virus. Non-limiting examples of glycoprotein sequences are provided as SEQ ID NOS: 573-796 and described in Table 9. In one exemplary embodiment, the glycoprotein incorporated into the XDP is glycoprotein G from vesicular stomatitis virus (VSV-G), which has the ability to bind to LDL receptors on a wide variety of mammalian cells (Finkelshtein, D., et al. LDL receptor and its family members serve as the cellular receptors for vesicular stomatitis virus. PNAS 110:7306(2013)). In another exemplary embodiment, the glycoprotein incorporated into the XDP is the glycoprotein from rabies virus. In some embodiments, the XDP of the present disclosure comprises one or more glycoprotein comprising a sequence of SEQ ID NOS: 573-796 as set forth in Table 9, or a sequence having at least 80%, at least 90%, at least 95%, at least 96%, at least 97%, at least 98%, at least 99% sequence identity thereto, wherein the glycoproteins are incorporated and exposed on the surface of the XDP, providing tropism and enhanced selectivity for the XDP to the target cell, organ, or tissue. In some embodiments, the XDP comprises a glycoprotein comprising a sequence selected from the group consisting of the sequences SEQ ID NOS: 573-796 as set forth in Table 9.

TABLE 9

Glycoproteins for incorporation into XDP

| Virus | Plasmid | Glycoprotein amino acid SEQ ID NO |
|---|---|---|
| Vesicular Stomatitis Virus | pGP2 | 573 |
| Human Immunodeficiency Virus | pGP3 | 574 |
| Avian leukosis virus | pGP4 | 575 |
| Rous Sarcoma Virus | pGP5 | 576 |
| Mouse mammary tumor virus | pGP6 | 577 |
| Human T-lymphotropic virus 1 | pGP7 | 578 |
| RD114 Endogenous Feline Retrovirus | pGP8 | 579 |
| Gibbon ape leukemia virus | pGP9 | 580 |
| Moloney Murine leukemia virus | pGP10 | 581 |
| Baboon Endogenous Virus | pGP11 | 582 |
| Human Foamy Virus | pGP12 | 583 |
| Pseudorabies virus | pGP13.1 | 584 |
| Pseudorabies virus | pGP13.2 | 585 |
| Pseudorabies virus | pGP13.3 | 586 |
| Pseudorabies virus | pGP13.4 | 587 |
| Herpes simplex virus 1 (HHV1) | pGP14.1 | 588 |
| Herpes simplex virus 1 (HHV1) | pGP14.2 | 589 |
| Herpes simplex virus 1 (HHV1) | pGP14.3 | 590 |
| Herpes simplex virus 1 (HHV1) | pGP14.4 | 591 |
| Hepatitis C Virus | pGP23 | 592 |
| Rabies Virus | pGP29 | 593 |
| Mokola Virus | pGP30 | 594 |
| Measles Virus | pGP32.1 | 595 |
| Measles Virus | pGP32.2 | 596 |
| Ebola Zaire Virus | pGP41 | 597 |
| Dengue | pGP25 | 598 |
| Zika virus | pGP26 | 599 |

TABLE 9-continued

Glycoproteins for incorporation into XDP

| Virus | Plasmid | Glycoprotein amino acid SEQ ID NO |
|---|---|---|
| West Nile Virus | pGP27 | 600 |
| Japanese Encephalitis Virus | pGP28 | 601 |
| Hepatitis G Virus | pGP24 | 602 |
| Mumps Virus F | pGP31.1 | 603 |
| Mumps Virus HN | pGP31.2 | 604 |
| Sendai Virus F | pGP33.1 | 605 |
| Sendai Virus HN | pGP33.2 | 606 |
| AcMNPV gp64 | pGP59 | 607 |
| Ross River Virus | pGP54 | 608 |
| Codon optimized rabies virus | pGP29.2 | 609 |
| Rabies virus (strain Nishigahara RCEH) (RABV) | pGP29.3 | 610 |
| Rabies virus (strain India) (RABV) | pGP29.4 | 611 |
| Rabies virus (strain CVS-11) (RABV) | pGP29.5 | 612 |
| Rabies virus (strain ERA) (RABV) | pGP29.6 | 613 |
| Rabies virus (strain SAD B19) (RABV) | pGP29.7 | 614 |
| Rabies virus (strain Vnukovo-32) (RABV) | pGP29.8 | 615 |
| Rabies virus (strain Pasteur vaccins / PV) (RABV) | pGP29.9 | 616 |
| Rabies virus (strain PM1503/AVO1) (RABV) | pGP29.1 | 617 |
| Rabies virus (strain China/DRV) (RABV) | pGP29.11 | 618 |
| Rabies virus (strain China/MRV) (RABV) | pGP29.12 | 619 |
| Rabies virus (isolate Human/Algeria/1991) (RABV) | pGP29.13 | 620 |
| Rabies virus (strain HEP-Flury) (RABV) | pGP29.14 | 621 |
| Rabies virus (strain silver-haired bat-associated) (RABV) (SHBRV) | pGP29.15 | 622 |
| HSV2 gB | pGP15.1 | 623 |
| HSV2 gD | pGP15.2 | 624 |
| HSV2 gH | pGP15.3 | 625 |
| HSV2 gL | pGP15.4 | 626 |
| Varicella gB | pGP16.1 | 627 |
| Varicella gK | pGP16.2 | 628 |
| Varicella gH | pGP16.3 | 629 |
| Varicella gL | pGP16.4 | 630 |
| Hepatitis B gL | pGP22.1 | 631 |
| Hepatitis B gM | pGP22.2 | 632 |
| Hepatitis B gS | pGP22.3 | 633 |
| Eastern equine encephalitis virus (EEEV) | pGP65 | 634 |
| Venezuelan equine encephalitis viruses (VEEV) | pGP66 | 635 |
| Western equine encephalitis virus (WEEV) | pGP67 | 636 |
| Semliki Forest virus | pGP68 | 637 |
| Sindbis virus | pGP69 | 638 |
| Chikungunya virus (CHIKV) | pGP70 | 639 |
| Bornavirus BoDV-1 | pGP58 | 640 |
| Tick-borne encephalitis virus (TBEV) | pGP71 | 641 |
| Usutu virus | pGP72 | 642 |
| St. Louis encephalitis virus | pGP73 | 643 |
| Yellow fever virus | pGP74 | 644 |
| Dengue virus 2 | pGP75 | 645 |
| Dengue virus 3 | pGP76 | 646 |
| Dengue virus 4 | pGP77 | 647 |
| Murray Valley encephalitis virus (MVEV) | pGP78 | 648 |
| Powassan virus | pGP79 | 649 |
| H5 Hemagglutinin | pGP80 | 650 |
| H7 Hemagglutinin | pGP81 | 651 |
| N1 Neuraminidase | pGP82 | 652 |
| Canine Distemper Virus | pGP83 | 653 |
| VSAV | pGP92 | 654 |
| ABVV | pGP99 | 655 |
| CARV | pGP98 | 656 |
| CHPV | pGP97 | 657 |
| COCV | pGP100 | 658 |
| VSIV | pGP91 | 659 |
| ISFV | pGP90 | 660 |
| JURV | pGP87 | 661 |
| MSPV | pGP89 | 662 |
| MARV | pGP88 | 663 |
| MORV | pGP101 | 664 |
| VSNJV | pGP84 | 665 |
| PERV | pGP85 | 666 |

TABLE 9-continued

Glycoproteins for incorporation into XDP

| Virus | Plasmid | Glycoprotein amino acid SEQ ID NO |
|---|---|---|
| PIRYV | pGP94 | 667 |
| RADV | pGP96 | 668 |
| YBV | pGP86 | 669 |
| VSV CEN AM-94GUB | pGP93 | 670 |
| VSV South America 85CLB | pGP95 | 671 |
| Nipah Virus | pGP34.1 | 672 |
| Nipah Virus | pGP34.2 | 673 |
| Hendra Virus | pGP35.1 | 674 |
| Hendra Virus | pGP35.2 | 675 |
| Newcastle disease virus | pGP37.1 | 676 |
| Newcastle disease virus | pGP37.2 | 677 |
| RSV f0 | pGP55.1 | 678 |
| RSV G | pGP55.2 | 679 |
| Bovine respiratory syncytial virus (strain Rb94) (BRS) | pGP102 | 680 |
| Murine pneumonia virus (strain 15) (MPV) | pGP103 | 681 |
| Measles virus (strain Edmonston) (MeV) (Subacute sclerose panencephalitis virus) | pGP104 | 682 |
| Measles virus (strain Edmonston B) (MeV) (Subacute sclerose panencephalitis virus) | pGP105 | 683 |
| Human respiratory syncytial virus B (strain B1) | pGP106 | 684 |
| Rinderpest virus (strain RBOK) (RDV) | pGP107 | 685 |
| Simian virus 41 (SV41) | pGP108 | 686 |
| Mumps virus (strain Miyahara vaccine) (MuV) | pGP109 | 687 |
| Canine distemper virus (strain Onderstepoort) (CDV) | pGP110 | 688 |
| Human respiratory syncytial virus A (strain Long) | pGP111 | 689 |
| Sendai virus (strain Fushimi) (SeV) | pGP112 | 690 |
| Human respiratory syncytial virus A (strain RSS-2) | pGP113 | 691 |
| Rinderpest virus (strain RBT1) (RDV) | pGP114 | 692 |
| Measles virus (strain Leningrad-16) (MeV) (Subacute sclerose panencephalitis virus) | pGP115 | 693 |
| Human parainfluenza 2 virus (HPIV-2) | pGP116 | 694 |
| Avian metapneumovirus (isolate Canada goose/Minnesota/15a/2001) (AMPV) | pGP117 | 695 |
| Phocine distemper virus (PDV) | pGP118 | 696 |
| Sendai virus (strain Harris) (SeV) | pGP119 | 697 |
| Bovine parainfluenza 3 virus (BPIV-3) | pGP120 | 698 |
| Measles virus (strain Ichinose-B95a) (MeV) (Subacute sclerose panencephalitis virus) | pGP121 | 699 |
| Human parainfluenza 2 virus (strain Toshiba) (HPIV-2) | pGP122 | 700 |
| Newcastle disease virus (strain Bl-Hitchner/47) (NDV) | pGP123 | 701 |
| Measles virus (strain Yamagata-1) (MeV) (Subacute sclerose panencephalitis virus) | pGP124 | 702 |
| Measles virus (strain IP-3-Ca) (MeV) (Subacute sclerose panencephalitis virus) | pGP125 | 703 |
| Measles virus (strain Edmonston-AIK-C vaccine) (MeV) (Subacute sclerose panencephalitis virus) | pGP126 | 704 |
| Turkey rhinotracheitis virus (TRTV) | pGP127 | 705 |
| Human parainfluenza 2 virus (strain Greer) (HPIV-2) | pGP128 | 706 |
| Hendra virus (isolate Horse/Autralia/Hendra/1994) | pGP129 | 707 |
| Human metapneumovirus (strain CAN97-83) (HMPV) | pGP130 | 708 |
| Bovine respiratory syncytial virus (strain Copenhagen) (BRS) | pGP131 | 709 |
| Sendai virus (strain Z) (SeV) (Sendai virus (strain HVJ)) | pGP132 | 710 |
| Human parainfluenza 3 virus (strain Wash/47885/57) (HPIV-3) (Human parainfluenza 3 virus (strain NIH 47885)) | pGP133 | 711 |
| Mumps virus (strain SBL-1) (MuV) | pGP134 | 712 |
| Measles virus (strain Edmonston-Zagreb vaccine) (MeV) (Subacute sclerose panencephalitis virus) | pGP135 | 713 |
| Human parainfluenza 1 virus (strain C39) (HPIV-1) | pGP136 | 714 |
| Sendai virus (strain Hamamatsu) (SeV) | pGP137 | 715 |
| Mumps virus (strain RW) (MuV) | pGP138 | 716 |
| Infectious hematopoietic necrosis virus (strain Oregon69) (IHNV) | pGP139 | 717 |
| Drosophila melanogaster sigma virus (isolate Drosophila/USA/AP30/2005) (DMelSV) | pGP140 | 718 |
| Hirame rhabdovirus (strain Korea/CA 9703/1997) (HIRRV) | pGP141 | 719 |
| Sonchus yellow net virus (SYNV) | pGP142 | 720 |
| European bat lyssavirus 1 (strain Bat/Germany/RV9/1968) (EBLV1) | pGP143 | 721 |
| Lagos bat virus (LBV) | pGP144 | 722 |
| Duvenhage virus (DUVV) | pGP145 | 723 |
| West Caucasian bat virus (WCBV) | pGP146 | 724 |
| European bat lyssavirus 2 (strain Human/Scotland/RV1333/2002) (EBLV2) | pGP147 | 725 |
| Irkut virus (IRKV) | pGP148 | 726 |
| Tupaia virus (isolate Tupaia/Thailand/-/1986) (TUPV) | pGP149 | 727 |
| Rabies virus (strain ERA) (RABV) | pGP150 | 728 |
| Ovine respiratory syncytial virus (strain WSU 83-1578) (ORSV) | pGP151 | 729 |
| Human respiratory syncytial virus A (strain rsb5857) | pGP152 | 730 |
| Piry virus (PIRYV) | pGP153 | 731 |
| Human respiratory syncytial virus A (strain rsb6190) | pGP154 | 732 |
| Rabies virus (strain SAD B19) (RABV) | pGP155 | 733 |
| Australian bat lyssavirus (isolate Human/AUS/1998) (ABLV) | pGP156 | 734 |
| Rabies virus (strain Vnukovo-32) (RABV) | pGP157 | 735 |
| Aravan virus (ARAV) | pGP158 | 736 |
| Sigma virus | pGP159 | 737 |
| Viral hemorrhagic septicemia virus (strain 07-71) (VHSV) | pGP160 | 738 |
| Rabies virus (strain Pasteur vaccins/PV) (RABV) | pGP161 | 739 |
| Bovine respiratory syncytial virus (strain Rb94) (BRS) | pGP162 | 740 |
| Tibrogargan virus (strain CS132) (TIBV) | pGP163 | 741 |
| Infectious hematopoietic necrosis virus (strain Round Butte) (IHNV) | pGP164 | 742 |
| Human respiratory syncytial virus B (strain 18537) | pGP165 | 743 |
| Adelaide River virus (ARV) | pGP166 | 744 |
| Australian bat lyssavirus (isolate Bat/AUS/1996) (ABLV) | pGP167 | 745 |
| Bovine ephemeral fever virus (strain BB7721) (BEFV) | pGP168 | 746 |
| Isfahan virus (ISFV) | pGP169 | 747 |
| Rabies virus (strain silver-haired bat-associated) (RABV) (SHBRV) | pGP170 | 748 |
| Snakehead rhabdovirus (SHRV) | pGP171 | 749 |
| Infectious hematopoietic necrosis virus (strain WRAC) (IHNV) | pGP172 | 750 |
| Zaire ebolavirus (strain Kikwit-95) (ZEBOV) (Zaire Ebola virus) | pGP173 | 751 |
| Sudan ebolavirus (strain Maleo-79) (SEBOV) (Sudan Ebola virus) | pGP174 | 752 |
| Tai Forest ebolavirus (strain Cote d'Ivoire-94) (TAFV) (Cote d'Ivoire Ebola virus) | pGP175 | 753 |
| Reston ebolavirus (strain Philippines-96) (REBOV) (Reston Ebola virus) | pGP176 | 754 |
| Lake Victoria marburgvirus (strain Angola/2005) (MARV) | pGP177 | 755 |
| Zaire ebolavirus (strain Eckron-76) (ZEBOV) (Zaire Ebola virus) | pGP178 | 756 |
| Reston ebolavirus (strain Reston-89) (REBOV) (Reston Ebola virus) | pGP179 | 757 |
| Tai Forest ebolavirus (strain Cote d'Ivoire-94) (TAFV) (Cote d'Ivoire Ebola virus) | pGP180 | 758 |

TABLE 9-continued

Glycoproteins for incorporation into XDP

| Virus | Plasmid | Glycoprotein amino acid SEQ ID NO |
|---|---|---|
| Lake Victoria marburgvirus (strain Ozolin-75) (MARV) (Marburg virus (strain South Africa/Ozolin/1975)) | pGP181 | 759 |
| Zaire ebolavirus (strain Mayinga-76) (ZEBOV) (Zaire Ebola virus) | pGP182 | 760 |
| Lake Victoria marburgvirus (strain Popp-67) (MARV) (Marburg virus (strain West Germany/Popp/1967)) | pGP183 | 761 |
| Sudan ebolavirus (strain Boniface-76) (SEBOV) (Sudan Ebola virus) | pGP184 | 762 |
| Reston ebolavirus (strain Reston-89) (REBOV) (Reston Ebola virus) | pGP185 | 763 |
| Sudan ebolavirus (strain Human/Uganda/Gulu/2000) (SEBOV) (Sudan Ebola virus) | pGP186 | 764 |
| Zaire ebolavirus (strain Gabon-94) (ZEBOV) (Zaire Ebola virus) | pGP187 | 765 |
| Reston ebolavirus (strain Reston-89) (REBOV) (Reston Ebola virus) | pGP188 | 766 |
| Simian virus 41 (SV41) | pGP189 | 767 |
| Newcastle disease virus (strain D26/76) (NDV) | pGP190 | 768 |
| Xenotropic MuLV-related virus (isolate VP42) (XMRV) | pGP191 | 769 |
| Xenotropic MuLV-related virus (isolate VP62) (XMRV) | pGP192 | 770 |
| Simian immunodeficiency virus (isolate F236/smH4) (SIV-sm) (Simian immunodeficiency virus sooty mangabey monkey) | pGP193 | 771 |
| Simian immunodeficiency virus (isolate Mm251) (SIV-mac) (Simian immunodeficiency virus rhesus monkey) | pGP194 | 772 |
| Simian immunodeficiency virus (isolate GB1) (SIV-mnd) (Simian immunodeficiency virus mandrill) | pGP195 | 773 |
| Simian immunodeficiency virus (isolate Mm142-83) (SIV-mac) (Simian immunodeficiency virus rhesus monkey) | pGP196 | 774 |
| Simian immunodeficiency virus (isolate MB66) (SIV-cpz) (Chimpanzee immunodeficiency virus) | pGP197 | 775 |
| Simian immunodeficiency virus (isolate EK505) (SIV-cpz) (Chimpanzee immunodeficiency virus) | pGP198 | 776 |
| Feline immunodeficiency virus (strain UK2) (FIV) | pGP199 | 777 |
| Feline immunodeficiency virus (strain San Diego) (FIV) | pGP200 | 778 |
| Feline immunodeficiency virus (isolate Wo) (FIV) | pGP201 | 779 |
| Feline immunodeficiency virus (isolate Petaluma) (FIV) | pGP202 | 780 |
| Feline immunodeficiency virus (strain UK8) (FIV) | pGP203 | 781 |
| Feline immunodeficiency virus (strain UT-113) (FIV) | pGP204 | 782 |
| Mayoro Virus | pGP205 | 783 |
| Barmah Forest Virus | pGP206 | 784 |
| Aura virus | pGP207 | 785 |
| Bebaru Virus | pGP208 | 786 |
| Middleburg virus | pGP209 | 787 |
| Mucambo virus | pGP210 | 788 |
| Ndumu Virus | pGP211 | 789 |
| O'nyong-nyong virus | pGP212 | 790 |
| Pixuna virus | pGP213 | 791 |
| Tonate Virus | pGP214 | 792 |
| Trocara virus | pGP215 | 793 |
| Whataroa virus | pGP216 | 794 |
| Bussuquara virus | pGP217 | 795 |
| Jugra virus | pGP218 | 796 |

In some embodiments, an XDP comprising a glycoprotein of the embodiments derived from an enveloped virus in a capsid of a XDP exhibits at least a 2-fold, or at least a 3-fold, or at least a 4-fold, or at least a 5-fold, or at least a 10-fold increase in binding of the XDP to a target cell compared to a XDP that does not have the glycoprotein, when assayed in an in vitro binding assay under comparable conditions. Representative examples demonstrating enhanced binding and uptake of XDP bearing glycoproteins to target cells leading to, in this case, enhanced gene editing of target nucleic acid, are provided in the Examples, below.

In some embodiments, the present disclosure provides XDP comprising an antibody fragment linked to the exterior of the particle wherein the antibody fragment has specific binding affinity to a target cell marker or receptor on a target cell, tissue or organ, providing tropism for the XDP for the target cell. In one embodiment, the antibody fragment is selected from the group consisting of an Fv, Fab, Fab', Fab'-SH, F(ab')2, diabody, single chain diabody, linear antibody, a single domain antibody, a single domain camelid antibody, and a single-chain variable fragment (scFv) antibody. The target cell marker or ligand can include cell receptors or surface proteins known to be expressed preferentially on a target cell for which nucleic acid editing or modification is desired. In such cases, a XDP comprising an antibody fragment in a capsid of a XDP of the embodiments exhibits at least a 2-fold, or at least a 3-fold, or at least a 4-fold, or at least a 5-fold, or at least a 10-fold increase in binding to a target cell bearing the target cell marker or receptor compared to a XDP that does not have the antibody fragment. In the case of antibody fragments with affinity to cell markers or receptors, the cell markers or receptors can include, but not be limited to cluster of differentiation 19 (CD19), cluster of differentiation 3 (CD3), CD3d molecule (CD3D), CD3g molecule (CD3G), CD3e molecule (CD3E), CD247 molecule (CD247, or CD3Z), CD8a molecule (CD8), CD7 molecule (CD7), membrane metalloendopeptidase (CD10), membrane spanning 4-domains A1 (CD20), CD22 molecule (CD22), TNF receptor superfamily member 8 (CD30), C-type lectin domain family 12 member A (CLL1), CD33 molecule (CD33), CD34 molecule (CD34), CD38 molecule (CD38), integrin subunit alpha 2b (CD41), CD44 molecule (Indian blood group) (CD44), CD47 molecule (CD47), integrin alpha 6 (CD49f), neural cell adhesion molecule 1 (CD56), CD70 molecule (CD70), CD74 molecule (CD74), CD99 molecule (Xg blood group) (CD99), interleukin 3 receptor subunit alpha (CD123), prominin 1 (CD133), syndecan 1 (CD138), carbonix anhydrase IX (CAIX), CC chemokine receptor 4 (CCR4), ADAM metallopeptidase domain 12 (ADAM12), adhesion G protein-coupled receptor E2 (ADGRE2), alkaline phosphatase placental-like 2 (ALPPL2), alpha 4 Integrin, angiopoietin-2 (ANG2), B-cell maturation antigen (BCMA), CD44V6, carcinoembryonic antigen (CEA), CEAC, CEA cell adhesion molecule 5 (CEACAM5), Claudin 6 (CLDN6), CLDN18, C-type lectin domain family 12 member A (CLEC12A), mesenchymal-epithelial transition factor (cMET), cytotoxic T-lymphocyte-associated protein 4 (CTLA4), epidermal growth factor receptor 1 (EGF1R), epidermal growth factor receptor variant III (EGFRvIII), epithelial glycoprotein 2 (EGP-2), epithelial cell adhesion molecule (EGP-40 or EpCAM), EPH receptor A2 (EphA2), ectonucleotide pyrophosphatase/phosphodiesterase 3 (ENPP3), erb-b2 receptor tyrosine kinase 2 (ERBB2), erb-b2 receptor tyrosine kinase 3 (ERBB3), erb-b2 receptor tyrosine kinase 4 (ERBB4), folate binding protein (FBP), fetal nicotinic acetylcholine receptor (AChR), folate receptor alpha (Fralpha or FOLR1), G protein-coupled receptor 143 (GPR143), glutamate metabotropic receptor 8 (GRM8), glypican-3 (GPC3), ganglioside GD2, ganglioside GD3, human epidermal growth factor receptor 1 (HER1), human epidermal growth factor receptor 2 (HER2), human epidermal growth factor receptor 3 (HER3), Integrin B7, intercellular cell-adhesion molecule-1 (ICAM-1), human telomerase reverse transcriptase (hTERT), Interleukin-13 receptor α2 (IL-13R-a2), K-light chain, Kinase insert domain receptor (KDR), Lewis-Y (LeY), chondromodulin-1 (LECT1), L1 cell adhesion molecule (L1CAM), Lysophosphatidic acid receptor 3 (LPAR3), melanoma-associated antigen 1 (MAGE-A1), mesothelin (MSLN), mucin 1 (MUC1), mucin 16, cell surface associated (MUC16), melanoma-associated antigen 3 (MAGEA3), tumor protein p53 (p53), Melanoma Antigen Recognized by T cells 1 (MART1), glycoprotein 100 (GP100), Proteinase3 (PR1), ephrin-A receptor 2 (EphA2), Natural killer group 2D ligand (NKG2D ligand), New York esophageal squamous cell carcinoma 1 (NY-ESO-1), oncofetal antigen (h5T4), prostate-specific membrane antigen (PSMA), programmed death ligand 1 (PDL-1), receptor tyrosine kinase-like orphan receptor 1 (ROR1), trophoblast glycoprotein (TPBG), tumor-associated glycoprotein 72 (TAG-72), tumor-associated calcium signal transducer 2 (TROP-2), tyrosinase, survivin, vascular endothelial growth factor receptor 2 (VEGF-R2), Wilms tumor-1 (WT-1), leukocyte immunoglobulin-like receptor B2 (LILRB2), Preferentially Expressed Antigen In Melanoma (PRAME), T cell receptor beta constant 1 (TRBC1), TRBC2, and (T-cell immunoglobulin mucin-3) TIM-3. In the case of antibody fragments with affinity to neuron receptors, the cell markers or receptors can include, but not be limited to Adrenergic (e.g., α1A, α1b, α1c, α1d, α2a, α2b, α2c, α2d, β1, β2, β3), Dopaminergic (e.g., D1, D2, D3, D4, D5), GABAergic (e.g., GABAA, GABAB1a, GABAB1δ, GABAB2, GABAC), Glutaminergic (e.g., NMDA, AMPA, kainate, mGluR1, mGluR2, mGluR3, mGluR4, mGluR5, mGluR6, mGluR7), Histaminergic (e.g., H1, H2, H3), Cholinergic (e.g., Muscarinic (e.g., M1, M2, M3, M4, M5; Nicotinic (e.g., muscle, neuronal (α-bungarotoxin-insensitive), neuronal (α-bungarotoxin-sensitive)), Opioid (e.g., μ, δ1, δ2, κ), and Serotonergic (e.g., 5-HT1A, 5-HT1B, 5-HT1D, 5-HT1E, 5-HT1F, 5-HT2A, 5-HT2B, 5-HT2C, 5-HT3, 5-HT4, 5-HT5, 5-HT6, 5-HT7).

In one embodiment, the antibody fragment is conjugated to the XDP after its production and isolation from the producing host cell. In another embodiment, the antibody fragment is produced and incorporated as a part of the XDP capsid expressed by the producing host cell of the XDP system. In some cases, the present disclosure provides a nucleic acid comprising a sequence encoding the antibody fragment operably linked to the nucleic acid encoding the XDP capsid or other XDP components.

VI. NUCLEIC ACIDS ENCODING XDP SYSTEMS

In another aspect, the present disclosure relates to nucleic acids encoding components of the XDP system and the incorporated therapeutic payloads, and the vectors that comprise the nucleic acids, as well as methods to make the nucleic acids and vectors.

In some embodiments, the present disclosure provides one or more nucleic acids encoding components including retroviral-derived XDP structural and processing components, as well as nucleic acids encoding therapeutic payloads and tropism factors. The nucleic acids and vectors utilized for the key structural components and for processing and the assembly of XDP particles of the embodiments can be derived from a variety of viruses, such as retroviruses, including but not limited to Retroviridae family members Alpharetroviruses, Betaretroviruses, Gammaretroviruses, Deltaretroviruses, Epsilonretroviruses, Spumaretrovirinae. In particular, components derived from lentiviruses such as human immunodeficiency-1 (HIV-1), human immunodeficiency-2 (HIV-2), simian immunodeficiency virus (SIV), feline immunodeficiency virus (FIV), bovine immunodeficiency virus (BIV), Jembrana Disease Virus (JDV), equine infectious anemia virus (EIAV), caprine arthritis encephalitis virus (CAEV) and the like are well-suited for incorporation into the XDP of the disclosure. The nucleic acids of the embodiments are incorporated into plasmid vectors that can be transfected into eukaryotic packaging host cells that, when cultured under appropriate conditions, lead to the expression of the XDP structural and processing components, therapeutic payloads, and tropism factors, self-assembly of the XDP particles that encapsidate the therapeutic payloads and incorporate the tropism factor upon budding from the packaging host cells. The nucleic acids can be designed to result in XDP in various configurations. Representative, but non-limiting configurations of XDPs are presented in Table 11, below, and are described more fully in the Examples.

In some embodiments, the nucleic acids encoding the XDP retroviral components are derived from Alpharetrovirus, including but not limited to avian leukosis virus (ALV) and Rous sarcoma virus (RSV). In some embodiments, the present disclosure provides nucleic acids encoding components selected from the group consisting of: a matrix polypeptide (MA); a p2A spacer peptide; ap2B spacer peptide; a p10 spacer peptide; a capsid polypeptide (CA); a nucleocapsid polypeptide (NC); a Gag polyprotein comprising a matrix polypeptide (MA), a capsid polypeptide (CA), p2A, p2B, p10, pp24, a nucleocapsid polypeptide (NC); an NCR protein; Rev protein; a therapeutic payload; a tropism factor; a Gag-transframe region protease polyprotein; a protease cleavage site(s); and a protease capable of cleaving the protease cleavage sites. In the forgoing embodiment, Gag components (e.g., MA, CA, p2A, p2B, p10, pp24, and NC), and optionally the protease cleavage site and protease, are derived from an Alpharetrovirus, including but not limited to Avian leukosis virus and Rous sarcoma virus. In some embodiments, the encoding sequences for the Alpharetrovirus-derived components are selected from the group consisting of SEQ ID NOS: 797-806 as set forth in Table 10, or a sequence having at least about 85%, at least about 90%, at least about 91%, at least about 92%, at least about 93%, at least about 94%, at least about 95%, at least about 96%, at least about 97%, at least about 98%, or at least about 99% identity thereto. In some embodiments, the nucleic acids encode a subset of the components listed supra. In some embodiments of the foregoing, encoding nucleotides for protease cleavage sites are located between each of the individual components. In other cases, the protease cleavage sites are omitted. In a particular embodiment, an encoding sequence for a single protease cleavage site is located between the sequence encoding the nuclease and the linked retroviral component, which may be a retroviral sequence or a non-viral sequence, such as one that can be cleaved by TEV, PreScission Protease, or any of the other proteases disclosed herein. Representative configurations and sequences are presented in the Examples. In some embodiments, the nucleic acid encodes a therapeutic payload comprising a protein, a nucleic acid, or comprises both a protein and a nucleic acid. In some embodiments, the nucleic acid encodes a therapeutic payload comprising a CRISPR Class 2 nuclease and a gRNA. In a particular embodiment, the encoded therapeutic payload is a CasX variant and gRNA variant embodiment described herein, while the encoded tropism factor is a viral glycoprotein embodiment described herein.

In some embodiments, the nucleic acids encoding the XDP viral components are derived from Betaretrovirus, including but not limited to mouse mammary tumor virus (MMTV), Mason-Pfizer monkey virus (MPMV), and enzootic nasal tumor virus (ENTV). In such embodiments, the present disclosure provides nucleic acids encoding the XDP wherein the XDP comprises components selected from the group consisting of: a matrix polypeptide (MA); a pp21/24 spacer peptide; a p3-P8/p12 spacer peptide; a capsid polypeptide (CA); a nucleocapsid polypeptide (NC); a Gag polyprotein comprising a matrix polypeptide (MA), a capsid polypeptide (CA), pp21/24, p3-8/p12, a nucleocapsid polypeptide (NC); an NCR protein; a therapeutic payload; a tropism factor; a Gag-transframe region protease polyprotein; a protease cleavage site(s); and a protease capable of cleaving the protease cleavage sites. In the forgoing embodiment, Gag components (e.g., MA, CA, pp21/24 spacer, p3-p8/p12 spacer, and NC), and optionally the protease cleavage site and protease, are derived from an Betaretrovirus, including but not limited to mouse mammary tumor virus, Mason-Pfizer monkey virus, and enzootic nasal tumor virus. In some embodiments, the encoding sequences for the Betaretrovirus-derived components are selected from the group consisting of SEQ ID NOS: 807-829 as set forth in Table 10, or a sequence having at least about 85%, at least about 90%, at least about 91%, at least about 92%, at least about 93%, at least about 94%, at least about 95%, at least about 96%, at least about 97%, at least about 98%, or at least about 99% identity thereto. In some embodiments, the nucleic acids encode a subset of the components listed in the paragraph. In some embodiments of the foregoing, encoding nucleotides for protease cleavage sites are located between each of the individual components. In other cases, the protease cleavage sites are omitted. In a particular embodiment, an encoding sequence for a single protease cleavage site is located between the sequence encoding the nuclease and the linked retroviral component, which may be a retroviral sequence or a non-viral sequence, such as one that can be cleaved by TEV, PreScission Protease, or any of the other proteases disclosed herein. Representative configurations and sequences are presented in the Examples. In some embodiments, the nucleic acid encodes a therapeutic payload comprising a protein, a nucleic acid, or comprises both a protein and a nucleic acid. In some embodiments, the nucleic acid encodes a therapeutic payload comprising a CRISPR Class 2 nuclease and a gRNA. In a particular embodiment, the encoded therapeutic payload is a CasX variant and gRNA variant embodiment described herein, while the encoded tropism factor is a viral glycoprotein embodiment described herein.

In some embodiments, the nucleic acids encoding the XDP viral components are derived from Deltaretrovirus, including but not limited to bovine leukemia virus (BLV) and the human T-lymphotropic viruses (HTLV1). In such embodiments, the present disclosure provides nucleic acids encoding the XDP wherein the XDP comprises components selected from the group consisting of: a matrix polypeptide (MA); a capsid polypeptide (CA); a nucleocapsid polypeptide (NC); a Gag polyprotein comprising a matrix polypeptide (MA), a capsid polypeptide (CA), a nucleocapsid polypeptide (NC); an NCR protein; a therapeutic payload; a tropism factor; a Gag-transframe region protease polyprotein; a protease cleavage site(s); and a protease capable of cleaving the protease cleavage sites. In the forgoing embodiment, Gag components (e.g., MA, CA, and NC), and optionally the protease cleavage site and protease, are derived from an Deltaretrovirus, including but not limited to bovine leukemia virus and the human T-lymphotropic viruses. In some embodiments, the encoding sequences for the Deltaretrovirus-derived components are selected from the group consisting of SEQ ID NOS: 830-847 as set forth in Table 10, or a sequence having at least about 85%, at least about 90%, at least about 91%, at least about 92%, at least about 93%, at least about 94%, at least about 95%, at least about 96%, at least about 97%, at least about 98%, or at least about 99% identity thereto. In some embodiments of the foregoing, encoding nucleotides for protease cleavage sites are located between each of the individual components. In other cases, the protease cleavage sites are omitted. In a particular embodiment, an encoding sequence for a single protease cleavage site is located between the sequence encoding the nuclease and the linked retroviral component, which may be a retroviral sequence or a non-viral sequence, such as one that can be cleaved by TEV, PreScission Protease, or any of the other proteases disclosed herein. Representative configurations and sequences are presented in the Examples. In some embodiments, the nucleic acid encodes a therapeutic payload comprising a protein, a nucleic acid, or comprises both a protein and a nucleic acid. In some embodiments, the nucleic acid encodes a therapeutic payload comprising a CRISPR Class 2 nuclease and a gRNA. In a particular embodiment, the encoded therapeutic payload is a CasX variant and gRNA variant embodiment described herein, while the encoded tropism factor is a viral glycoprotein embodiment described herein.

In some embodiments, the nucleic acids encoding the XDP viral components are derived from Epsilonretrovirus, including but not limited to Walleye dermal sarcoma virus (WDSV), and Walleye epidermal hyperplasia virus 1 and 2. In such embodiments, the present disclosure provides nucleic acids encoding the XDP wherein the XDP comprises components selected from the group consisting of: a matrix polypeptide (MA); a p20 spacer peptide; a capsid polypeptide (CA); a nucleocapsid polypeptide (NC); a Gag polyprotein comprising a matrix polypeptide (MA), a capsid polypeptide (CA), p20, a nucleocapsid polypeptide (NC); an NCR protein; a therapeutic payload; a tropism factor; a Gag-transframe region-protease polyprotein; a protease cleavage site(s); and a protease capable of cleaving the protease cleavage sites. In the forgoing embodiment, Gag components (e.g., MA, CA, p20, and NC), and optionally the protease cleavage site and protease, are derived from an Epsilonretrovirus, including but not limited to Walleye dermal sarcoma virus, and Walleye epidermal hyperplasia virus 1 and 2. In some embodiments, the encoding sequences for the Epsilonretrovirus-derived components are selected from the group consisting of SEQ ID NOS: 848-853 as set forth in Table 10, or a sequence having at least about 85%, at least about 90%, at least about 91%, at least about 92%, at least about 93%, at least about 94%, at least about 95%, at least about 96%, at least about 97%, at least about 98%, or at least about 99% identity thereto. In some embodiments of the foregoing, encoding nucleotides for protease cleavage sites are located between each of the individual components. In other cases, the protease cleavage sites are omitted. In a particular embodiment, an encoding sequence for a single protease cleavage site is located between the sequence encoding the nuclease and the linked retroviral component, which may be a retroviral sequence or a non-viral sequence, such as one that can be cleaved by TEV, PreScission Protease, or any of the other proteases disclosed herein. Representative configurations and sequences are presented in the Examples. In some embodiments, the nucleic acid encodes a therapeutic payload comprising a protein, a nucleic acid, or comprises both a protein and a nucleic acid. In some embodiments, the nucleic acid encodes a therapeutic payload comprising a CRISPR Class 2 nuclease and a gRNA. In a particular embodiment, the encoded therapeutic payload is a CasX variant and gRNA variant embodiment described herein, while the encoded tropism factor is a viral glycoprotein embodiment described herein.

In some embodiments, the nucleic acids encoding the XDP viral components are derived from Gammaretrovirus, including but not limited to murine leukemia virus (MLV), Maloney murine leukemia virus (MMLV), and feline leukemia virus (FLV). In such embodiments, the nucleic acids encoding the present disclosure provides XDP wherein the XDP comprises components selected from the group consisting of: a matrix polypeptide (MA); a p12 spacer peptide; a capsid polypeptide (CA); a nucleocapsid polypeptide (NC); a Gag polyprotein comprising a matrix polypeptide (MA), a p12 spacer, a capsid polypeptide (CA), a nucleocapsid polypeptide (NC); an NCR protein; a therapeutic payload; a tropism factor; a Gag-transframe region-protease polyprotein; a protease cleavage site(s); and a protease capable of cleaving the protease cleavage sites. In the forgoing embodiment, Gag components (e.g., MA, p12, CA, and NC), and optionally the protease cleavage site and protease, are derived from an Gammaretrovirus, including but not limited to Walleye dermal sarcoma virus, and Walleye epidermal hyperplasia virus 1 and 2. In some embodiments, the encoding sequences for the Gammaretrovirus-derived components are selected from the group consisting of SEQ ID NOS: 854-865 as set forth in Table 10, or a sequence having at least about 85%, at least about 90%, at least about 91%, at least about 92%, at least about 93%, at least about 94%, at least about 95%, at least about 96%, at least about 97%, at least about 98%, or at least about 99% identity thereto. In some embodiments of the foregoing, encoding nucleotides for protease cleavage sites are located between each of the individual components. In other cases, the protease cleavage sites are omitted. In a particular embodiment, an encoding sequence for a single protease cleavage site is located between the sequence encoding the nuclease and the linked retroviral component, which may be a retroviral sequence that can be cleaved by the retroviral protease, or may be a non-viral sequence, such as one that can be cleaved by TEV, PreScission Protease, or any of the other proteases disclosed herein. Representative configurations and sequences are presented in the Examples. In some embodiments, the nucleic acid encodes a therapeutic payload comprising a protein, a nucleic acid, or comprises both a protein and a nucleic acid. In some embodiments, the nucleic acid encodes a therapeutic payload comprising a CRISPR Class 2 nuclease and a gRNA. In a particular embodiment, the encoded therapeutic payload is a CasX variant and gRNA variant embodiment described herein, while the encoded tropism factor is a viral glycoprotein embodiment described herein.

In some embodiments, the nucleic acids encoding the XDP viral components are derived from Lentivirus, including but not limited to HIV-1 and HIV-2, and Simian immunodeficiency virus (SIV). In such cases, the present disclosure provides nucleic acids encoding the XDP wherein the XDP comprises components selected from the group consisting of: a matrix polypeptide (MA); a capsid (CA), a p2 spacer peptide, a nucleocapsid (NC), a p1 spacer peptide, a p6 spacer peptide); a Gag polyprotein comprising a matrix polypeptide (MA), CA, P2, NC, a p1 spacer peptide, and a p6 spacer peptide; an NCR protein; a therapeutic payload; a tropism factor; a Gag-transframe region-protease polyprotein; a protease cleavage site(s); and a protease capable of cleaving the protease cleavage sites. In the forgoing embodiment, Gag components (e.g., MA, CA, NC, and p1 and p6), and optionally the protease cleavage site and protease, are derived from a Lentivirus, including but not limited to HIV-1, HIV-2, and Simian immunodeficiency virus (SIV). In some embodiments of the foregoing, encoding nucleotides for protease cleavage sites are located between each of the individual components of Gag. In one embodiment of the foregoing, the encoded sequences are the HIV-1 sequences SQNYPIVQ (SEQ ID NO: 35035) (in between MA and CA), ARVLAEAM (SEQ ID NO: 35036) (in between CA and P2), ATIMIQKG (SEQ ID NO: 35037) (in between P2 and NC), RQANFLGK (SEQ ID NO: 35038) (in between NC and P1), PGNFLQSR (in between P1 and P6), and SFSFPQIT (SEQ ID NO: 35039) (in between Gag and Pro in the Gag-TFR-PR). In some embodiments, the encoding sequences for the Lentivirus-derived components are selected from the group consisting of SEQ ID NOS: 917-922 and 1859-1865 as set forth in Table 10, or a sequence having at least about 85%, at least about 90%, at least about 91%, at least about 92%, at least about 93%, at least about 94%, at least about 95%, at least about 96%, at least about 97%, at least about 98%, or at least about 99% identity thereto. In some embodiments of the foregoing, encoding nucleotides for protease cleavage sites are located between each of the individual components. In other cases, the protease cleavage sites are omitted. In a particular embodiment, an encoding sequence for a single protease cleavage site is located between the sequence encoding the nuclease and the linked retroviral component, which may be a retroviral sequence or a non-viral sequence, such as one that can be cleaved by TEV, PreScission Protease, or any of the other proteases disclosed herein. Representative configurations and sequences are presented in the Examples. In some embodiments, the nucleic acid encodes a therapeutic payload comprising a protein, a nucleic acid, or comprises both a protein and a nucleic acid. In some embodiments, the nucleic acid encodes a therapeutic payload comprising a CRISPR Class 2 nuclease and a gRNA. In a particular embodiment, the encoded therapeutic payload is a CasX variant and gRNA variant embodiment described herein, while the encoded tropism factor is a viral glycoprotein embodiment described herein.

In some embodiments, the nucleic acids encoding the XDP viral components are derived from Spumaretrovirinae, including but not limited to Bovispumavirus, Equispumavirus, Felispumavirus, Prosimiispumavirus, Simiispumavirus, and Spumavirus. In such cases, the present disclosure provides nucleic acids encoding the XDP wherein the XDP comprises components selected from the group consisting of: P68 Gag; a p3 Gag; a Gag polyprotein comprising of P68 Gag and p3 gag; an NCR protein; a therapeutic payload; a tropism factor; a Gag-transframe region-protease polyprotein; a protease cleavage site(s); and a protease capable of cleaving the protease cleavage sites. In the forgoing embodiment, Gag components (e.g., MA, CA, p20, and NC), and optionally the protease cleavage site and protease, are derived from an Spumaretrovirinae including but not limited to Bovispumavirus, Equispumavirus, Felispumavirus, Prosimiispumavirus, Simiispumavirus, and Spumavirus. In some embodiments, the encoding sequences for the Sumaretrovirinae-derived components are selected from the group consisting of SEQ ID NOS: 896-916 as set forth in Table 10, or a sequence having at least about 85%, at least about 90%, at least about 91%, at least about 92%, at least about 93%, at least about 94%, at least about 95%, at least about 96%, at least about 97%, at least about 98%, or at least about 99% identity thereto. In some embodiments of the foregoing, encoding nucleotides for protease cleavage sites are located between each of the individual components. In other cases, the protease cleavage sites are omitted. In a particular embodiment, an encoding sequence for a single protease cleavage site is located between the sequence encoding the nuclease and the linked retroviral component, which may be a retroviral cleavage sequence or a non-viral cleavage sequence, such as one that can be cleaved by TEV, PreScission Protease, or any of the other proteases disclosed herein. Representative configurations and sequences are presented in the Examples. In some embodiments, the nucleic acid encodes a therapeutic payload comprising a protein, a nucleic acid, or comprises both a protein and a nucleic acid. In some embodiments, the nucleic acid encodes a therapeutic payload comprising a CRISPR Class 2 nuclease and a gRNA. In a particular embodiment, the encoded therapeutic payload is a CasX variant and gRNA variant embodiment described herein, while the encoded tropism factor is a viral glycoprotein embodiment described herein.

In other embodiments, the present disclosure provides nucleic acids encoding the XDP wherein the retroviral components of the XDP are selected from different genera of the Retroviridae. Thus the nucleic acids encoding the XDP can comprise two or more components selected from a matrix polypeptide (MA), a p2A spacer peptide, a p2B spacer peptide; a p10 spacer peptide, a capsid polypeptide (CA), a nucleocapsid polypeptide (NC), a pp21/24 spacer peptide, a p3-p8 spacer peptide, a p12 spacer peptide, a p20 spacer peptide, a p1 spacer peptide, a p6 spacer peptide, a p68 Gag, a p3 Gag, a cleave site(s), and a protease capable of cleaving the protease cleavage sites wherein the components are derived from two or more of Alpharetrovirus, Betaretrovirus, Deltaretrovirus, Epsilonretrovirus, Gammaretrovirus, Lentivirus, Bovispumavirus, Equispumavirus, Felispumavirus, Prosimiispumavirus, Simiispumavirus, or Spumavirus.

In retroviral components derived from HIV-1, the accessory protein integrase (or its encoding nucleic acid) can be omitted from the XDP systems, as well as the HIV functional accessory genes vpr, vpx (HIV-2), which are dispensable for viral replication in vitro. Additionally, the nucleic acids of the XDP system do not require reverse transcriptase for the creation of the XDP compositions of the embodiments. Thus, in one embodiment, the HIV-1 Gag-Pol component of the XDP can be truncated to Gag linked to the transframe region (TFR) composed of the transframe octapeptide (TFP) and 48 amino acids of the p6pol encoding the protease, separated by a protease cleavage site, hereinafter referred to as Gag-TFR-PR, described more fully, below.

Table 10: DNA Sequences encoding Retroviral components

Table 10 is included as FIG. 115.

* denotes wild-type sequence (optionally incorporated, depending on configuration)

In some embodiments, the present disclosure provides nucleic acids encoding sequences for the tropism factors that are incorporated in, and displayed on the surface of the XDP, wherein the tropism factor confers an increased ability of the XDP to bind and fuse with the membrane of a target cell, organ, or tissue. In one embodiment, the tropism factor is a glycoprotein, wherein the encoding nucleic acid encodes a glycoprotein comprising a sequences selected from the group consisting of SEQ ID NOS: 573-796 of Table 9, or a sequence having at least about 85%, at least about 90%, at least about 91%, at least about 92%, at least about 93%, at least about 94%, at least about 95%, at least about 96%, at least about 97%, at least about 98%, or at least about 99% identity thereto. In another embodiment, the disclosure provides a nucleic acid encoding an antibody fragment, wherein the antibody fragment has specific binding affinity for a target cell marker or receptor on a target cell, organ, or tissue. In another embodiment, the disclosure provides nucleic acids encoding a cell receptor, wherein the cell receptor has specific binding affinity for a target cell marker on a target cell, organ, or tissue. In another embodiment, the disclosure provides nucleic acids encoding a ligand, wherein the ligand has specific binding affinity for a target cell marker or receptor on a target cell, organ, or tissue. By inclusion of the nucleic acids encoding for the tropism factors, it will be understood that the resulting XDP will have increased selectivity for the target cell, organ, or tissue, resulting in an increased therapeutic index and reduced off-target effects.

The present disclosure further provides nucleic acids encoding or comprising the therapeutic payloads incorporated into the XDP. Exemplary therapeutic payloads have been described herein, supra. In some embodiments, the therapeutic payload of the XDP is a CRISPR Class 2 nuclease and one or more guide RNAs. In a particular embodiment of the foregoing, the disclosure provides nucleic acids encoding the CasX variant nucleases of SEQ ID NOS: 135-457, 937-950, 1884-1929 or 35044-35047 as set forth in Tables 3 and 12, or a sequence having at least about 85%, at least about 90%, at least about 91%, at least about 92%, at least about 93%, at least about 94%, at least about 95%, at least about 96%, at least about 97%, at least about 98%, or at least about 99% identity thereto. Representative examples of such nucleic acids are presented in Table 12 of the Examples. In another particular embodiment of the foregoing, the disclosure provides nucleic acids encoding the gRNA variants comprise a sequence selected from the group consisting 1959-2010 and 2238-2377 as set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% identity thereto, and wherein the gRNA further comprises a targeting sequence complementary to a target nucleic acid.

In some embodiments, wherein a first and a second gRNA variant is utilized for XDP having two different RNPs targeting different target nucleic acids, the disclosure provides nucleic acids encoding a first and a second gRNA variant, each having different targeting sequences complementary to a different region of the target nucleic acid or to different genes in the case of a bispecific system. In some embodiments, the nucleic acids encode gRNA scaffolds that are identical, while the sequences encoding the targeting sequence are different. In other embodiments, the first and the second gRNA variant scaffolds are different, and are encoded by different nucleic acid sequences (optionally, also with different targeting sequences).

In some embodiments of the disclosure, the components of the XDP systems are encoded by two, three, four, five or more nucleic acids, which can encode single components or multiple components that are operably linked to (under the control of) accessory elements operable in a eukaryotic cell and appropriate for the component to be expressed. It will be understood that in the descriptions of the XDP system configurations, the absolute order of the components encoded within a nucleic acid may be varied in order to take advantage of the placement of the accessory elements, cleavage sequences and the like, such that each component can be expressed and/or utilized in the assembly of the XDP in an optimal fashion, as would be understood by one of ordinary skill in the art. For example, where a nucleic acid encodes the Gag polyprotein, the therapeutic payload, and a protease cleavage site, the order (5' to 3') may be Gag-cleavage site-therapeutic payload or it may be therapeutic payload-cleavage site-Gag, and it is intended that the same would apply for any combination of components encoded in a single nucleic acid. Representative, but non-limiting configurations of the design of XDP components and the plasmids that encode them are presented in Table 11, and are more fully described in the Examples, below. In XDP systems comprising two different RNPs, the plasmid encoding the sgRNA of Table 11 can be configured to encode both guides. In other embodiments, an additional plasmid comprising the nucleic acid encoding the second gRNA can be utilized in the system.

TABLE 11

Representative XDP plasmids and nucleic acid configurations

| XDP Version | Plasmid | Encoded Components** |
|---|---|---|
| 206 | 1 | MA*-CA*-NC*-p1*-p6-NCR protein |
|  | 2 | MA*-CA*-NC*-p1*-p6*-Pro† |
|  | 3 | CasX |
|  | 4 | Tropism Factor |
|  | 5 | sgRNA |
| 168 | 1 | MA*-CA*-NC*-p1*-p6*-CasX |
|  | 2 | MA*-CA*-NC*-p1*-p6*-Pro† |
|  | 3 | Tropism Factor |
|  | 4 | sgRNA |
| 263 | 1 | MA*-CA-NCR protein*NC*-p1*-p6 |
|  | 2 | MA*-CA*-NC*-p1*-p6*-Pro† |
|  | 3 | CasX |
|  | 4 | Tropism Factor |
|  | 5 | sgRNA |
| 264 | 1 | MA*-NCR protein-CA*-NC*-p1*-p6 |
|  | 2 | MA*-CA*-NC*-p1*-p6*-Pro† |
|  | 3 | CasX |
|  | 4 | Tropism Factor |
|  | 5 | sgRNA |
| 265 | 1 | MA*-CA*-NCR protein*-NC*-p1*-p6 |
|  | 2 | MA*-CA*-NC*-p1*-p6*-Pro† |
|  | 3 | CasX |
|  | 4 | Tropism Factor |
|  | 5 | sgRNA |
| 266 | 1 | MA*-NCR protein*-CA*-NC*-p1*-p6 |
|  | 2 | MA*-CA*-NC*-p1*-p6*-Pro† |
|  | 3 | CasX |
|  | 4 | Tropism Factor |
|  | 5 | sgRNA |
| 267 | 1 | MA*-CA-NC-NCR protein*-p1*-p6 |
|  | 2 | MA*-CA*-NC*-p1*-p6*-Pro† |
|  | 3 | CasX |
|  | 4 | Tropism Factor |
|  | 5 | sgRNA |
| 268 | 1 | MA*-CA*-NC*-NCR protein*-p1*-p6 |
|  | 2 | MA*-CA*-NC*-p1*-p6*-Pro† |
|  | 3 | CasX |
|  | 4 | Tropism Factor |
|  | 5 | sgRNA |
| 269 | 1 | MA*-CA*-NCR protein-NC*-p1*-p6 |
|  | 2 | MA*-CA*-NC*-p1*-p6*-Pro† |
|  | 3 | CasX |
|  | 4 | Tropism Factor |
|  | 5 | sgRNA |
| 270 | 1 | MA*-CA*-NCR protein*-NC*-p1*-p6 |
|  | 2 | MA*-CA*-NC*-p1*-p6*-Pro† |
|  | 3 | CasX |
|  | 4 | Tropism Factor |
|  | 5 | sgRNA |
| 416-424 | 1 | MA*-CA*-NC*-p1*-p6-NCR protein |
|  | 2 | MA*-CA*-NC*-p1*-p6*-Pro† |
|  | 3 | CasX |
|  | 4 | Tropism Factor |
|  | 5 | sgRNA |
| 309 | 1 | MA*-CA*-NC*-p1*-p6-NCR protein-NCR protein |
|  | 2 | MA*-CA*-NC*-p1*-p6*-Pro† |
|  | 3 | CasX |
|  | 4 | Tropism Factor |
|  | 5 | sgRNA |
| 207 | 1 | MA*-CA*-NC*-p1*-p6*-Pro† |
|  | 2 | CasX |
|  | 3 | Tropism Factor |
|  | 4 | sgRNA |
| 168 | 1 | MA*-CA*-NC*-p1*-p6*-CasX |
|  | 2 | MA*-CA*-NC*-p1*-p6*-Pro† |
|  | 3 | Tropism Factor |
|  | 4 | sgRNA |
| 44 | 1 | MA*-p12*-CA*-NC*-Pro*-CasX |
|  | 2 | Tropism Factor |
|  | 3 | sgRNA |
| 102 | 1 | MA*-p12*-CA*-NC*-CasX |
|  | 2 | Tropism Factor |
|  | 3 | sgRNA |
| 204 | 1 | MA*-CA*-NC*-p1*-p6*-Pro† |
|  | 2 | VPR-CasX |
|  | 3 | Tropism Factor |
|  | 4 | sgRNA |
| 207 | 1 | MA*-CA*-NC*-p1*-p6*-Pro† |
|  | 2 | CasX |
|  | 3 | Tropism Factor |
|  | 4 | sgRNA |
| 271 | 1 | MA*-p12*-CA*-NC*-Pro*-NCR protein |
|  | 2 | CasX |
|  | 3 | Tropism Factor |
|  | 4 | sgRNA |
| 272 | 1 | MA*-p12*-CA*-NC*-NCR protein |
|  | 2 | CasX |
|  | 3 | Tropism Factor |
|  | 4 | sgRNA |
| 273 | 1 | MA*-p12*-CA*-NC*-Pro*-NCR protein |
|  | 2 | CasX |
|  | 3 | Tropism Factor |
|  | 4 | sgRNA |
| 274 | 1 | MA*-CA*-NC*-Pro†*-NCR protein |
|  | 2 | CasX |
|  | 3 | Tropism Factor |
|  | 4 | sgRNA |
| 275 | 1 | MA*-CA*-NC*-Pro†*-NCR protein |
|  | 2 | CasX |
|  | 3 | Tropism Factor |
|  | 4 | sgRNA |
| 276 | 1 | MA*-p12*-CA*-NC*-Pro†*-NCR protein |
|  | 2 | CasX |
|  | 3 | Tropism Factor |
|  | 4 | sgRNA |
| 277 | 1 | MA*-pp21*-p3*-p8*-CA*-NC*-Pro†*-NCR protein |
|  | 2 | CasX |
|  | 3 | Tropism Factor |
|  | 4 | sgRNA |
| 278 | 1 | MA*-p12*-CA*-NC*-Pro†*-NCR protein |
|  | 2 | CasX |
|  | 3 | Tropism Factor |
|  | 4 | sgRNA |
| 279 | 1 | MA*-pp24*-p18*-p12*-CA*-NC*-Pro†*-NCR protein |
|  | 2 | CasX |

TABLE 11-continued

Representative XDP plasmids and nucleic acid configurations

| XDP Version | Plasmid | Encoded Components** |
|---|---|---|
| | 3 | Tropism Factor |
| | 4 | sgRNA |
| 280 | 1 | MA*-C A*-NC*-p6*-Pro†*-NCR protein |
| | 2 | CasX |
| | 3 | Tropism Factor |
| | 4 | sgRNA |
| 310, 311 | 1 | MA*-CA*-NC*-p1*-p6*-CasX |
| | 2 | MA*-CA*-NC*p1*-p6*-Pro†*-RT*-INT |
| | 3 | Tropism Factor |
| | 4 | sgRNA |

*indicates cleavage sequence between adjacent components
**5' to 3' orientation
†indicates a-1 frame-shift in the encoded construct (Gag-TFR-PR polyprotein), where PR stands for protease and TFR stands for transframe region In some embodiments, the disclosure provides nucleic acids comprising sequences encoding components of the XDP system selected from two or more of a retroviral Gag polyprotein (all or portions thereof), a protease cleavage site, a therapeutic payload, an NCR protein, a Gag-TFR-PR polyprotein, and a tropism factor, wherein the components are encoded on two, three, four or five individual nucleic acids. In some embodiments of the foregoing, a first nucleic acid encodes the Gag polyprotein (or portions thereof) and the CasX protein as the therapeutic payload with, optionally, an intervening protease cleavage site between the two components, and a second nucleic acid encodes the Gag-TFR-PR polyprotein (or portions thereof), the tropism factor and the gRNA. In another embodiment of the foregoing, a first nucleic acid encodes the Gag polyprotein (or portions thereof) and the CasX protein as the therapeutic payload with, optionally, and intervening protease cleavage site separating the two components, a second nucleic acid encodes the Gag-TFR-PR polyprotein, and a third nucleic acid encodes the tropism factor and the gRNA. In another embodiment, a first nucleic acid encodes the Gag polyprotein (or portions thereof) and the CasX protein as the therapeutic payload with, optionally, an intervening protease cleavage site separating the two components, a second nucleic acid encodes the tropism factor, a third nucleic acid encodes the Gag-TFR-PR polyprotein (or portions thereof), and a fourth nucleic acid encodes the gRNA. In some cases, the protease cleavage sites are omitted. In other cases, protease cleavage sites are located between each component of the Gag polyprotein and, optionally, the therapeutic payload. Representative examples of the encoding nucleic acids of the foregoing embodiments are presented in the Examples.

In other embodiments, the disclosure provides nucleic acids comprising sequences encoding components of the XDP system comprising the Gag-TFR-PR polyprotein (or portions thereof), the protease cleavage site, the CasX protein as the therapeutic payload, the gRNA, and the tropism factor, wherein the components are encoded on two or three individual nucleic acids. In another embodiment of the foregoing, a first nucleic acid encodes the Gag-TFR-PR polyprotein and the CasX protein as the therapeutic payload with an intervening protease cleavage site separating the two components, and a second nucleic acid encodes the tropism factor and the gRNA. In another embodiment, a first nucleic acid encodes the Gag-TFR-PR polyprotein and the CasX protein as the therapeutic payload with an intervening protease cleavage site separating the two components, a second nucleic acid encodes the tropism factor, and a third nucleic acid encodes the gRNA. In some embodiments of the foregoing, protease cleavage sites are located between each component of the Gag polyprotein and, optionally, the CasX protein. Representative examples of the encoding nucleic acids of the foregoing embodiments are presented in the Examples (see Tables 10, 12, 16, 17, 19, 20, 21, 24, 27, 30, 34, 35, 38, 40, 42, 43, 46, 47, 48, 51, 52, 54, 57, 58, 60, 62, 65, 66, 68, 69, 72, 73, 78, 80, 83, 87, 88, 90, and 104 and the sequences contained therein).

In other embodiments, the disclosure provides nucleic acids comprising sequences encoding components of the XDP system comprising the Gag-TFR-PR polyprotein, the CasX protein, the protease cleavage site, the gRNA, the RNA binding domain, and the tropism factor, wherein the components are encoded on two, or three individual nucleic acids. In another case of the foregoing, a first nucleic acid encodes the Gag-TFR-PR polyprotein and the CasX with an intervening protease cleavage site between the two components, and a second nucleic acid encodes the tropism factor, the gRNA and the RNA binding partner domain. In another case of the foregoing, a first nucleic acid encodes the Gag-TFR-PR polyprotein and the CasX with an intervening protease cleavage site between the two components, and a second nucleic acid encodes the tropism factor, and a third nucleic acid encodes the gRNA and the RNA binding partner domain.

In other embodiments, the disclosure provides nucleic acids comprising sequences encoding components of the XDP system comprising the MA (and, optionally, the CA and NC), the CasX protein, the protease, the protease cleavage site, the gRNA, and the tropism factor, wherein the components are encoded on two, three, or four individual nucleic acids. In other cases of the foregoing, a first nucleic acid encodes the first nucleic acid encodes the MA, the CasX protein, the protease, and intervening protease cleavage sites between the three components, and a second nucleic acid encodes the tropism factor and the gRNA. In other cases, a first nucleic acid encodes the MA, the CasX protein the protease, and intervening protease cleavage sites between the three components, a second nucleic acid encodes the tropism factor; and a third nucleic acid encodes the gRNA. In other cases, a first nucleic acid encodes the MA and the CasX protein with an intervening protease cleavage site between the two components, a second nucleic acid encodes the tropism factor, a third nucleic acid encodes the gRNA, and a fourth nucleic acid encodes the protease. In the foregoing embodiments, the first nucleic acid can further encode a CA component linked to the MA by an additional intervening protease cleavage site. In some embodiments of the foregoing, the protease and protease cleavage sites are omitted.

In some embodiments, the disclosure provides nucleic acids comprising sequences encoding components of the XDP system comprising the Gag polyprotein (all or portions thereof), the CasX protein, the protease, the protease cleavage site, the gRNA, the tropism factor, and the Gag-TFR-PR polyprotein (all or portions thereof), wherein the components are encoded on two, three, or four individual nucleic acids. In some embodiments of the foregoing, a first nucleic acid encodes the Gag polyprotein, the CasX protein, the protease, and intervening protease cleavage sites between the three components, and a second nucleic acid encodes the Gag-TFR-PR polyprotein, the tropism factor, and the gRNA. In other embodiments, a first nucleic acid encodes the Gag polyprotein and the CasX protein with an intervening protease cleavage site between the two components, a second nucleic acid encodes the protease, and a third nucleic acid encodes the tropism factor, the gRNA, and the Gag-TFR-PR polyprotein. In other embodiments, a first nucleic acid encodes the Gag polyprotein, and the CasX protein with an intervening protease cleavage site between the two components, a second nucleic acid encodes the protease, a third nucleic acid encodes the tropism factor, and a fourth nucleic acid encodes the gRNA and the Gag-TFR-PR polyprotein. In some embodiments of the foregoing, the protease and protease cleavage sites are omitted.

In other embodiments, components of various configurations of the XDP system are encoded by a portion or all of a sequence selected from the group consisting of the nucleic acid sequences as set forth in Tables 10, 12, 16, 17, 19, 20, 21, 24, 27, 30, 34, 35, 38, 40, 42, 43, 46, 47, 48, 51, 52, 54, 57, 58, 60, 62, 65, 66, 68, 69, 72, 73, 78, 80, 83, 87, 88, 90, and 104, or a sequence having at least about 80%, at least about 90%, at least about 95%, at least about 95%, at least about 96%, at least about 97%, at least about 98%, at least about 99% sequence identity thereto.

In some embodiments, the nucleic acids encoding the XDP system of any of the embodiments described herein further comprises a donor template nucleic acid wherein the donor template comprises a sequence to be inserted into a target nucleic acid to either correct a mutation or to knockdown or knock-out a gene. In some embodiments, the donor template sequence comprises a non-homologous sequence flanked by two regions of homology 5' and 3' to the break sites of the target nucleic acid (i.e., homologous arms), facilitating insertion of the non-homologous sequence at the target region which can be mediated by HDR or HITI. The exogenous donor template inserted by HITI can be any length, for example, a relatively short sequence of between 1 and 50 nucleotides in length, or a longer sequence of about 50-1000 nucleotides in length. The lack of homology can be, for example, having no more than 20-50% sequence identity and/or lacking in specific hybridization at low stringency. In other cases, the lack of homology can further include a criterion of having no more than 5, 6, 7, 8, or 9 bp identity. In such cases, the use of homologous arms facilitates the insertion of the non-homologous sequence at the break site(s) introduced by the nuclease. In some embodiments, the donor template polynucleotide comprises at least about 10, at least about 50, at least about 100, or at least about 200, or at least about 300, or at least about 400, or at least about 500, or at least about 600, or at least about 700, or at least about 800, or at least about 900, or at least about 1000, or at least about 10,000, or at least about 15,000 nucleotides. In other embodiments, the donor template comprises at least about 10 to about 15,000 nucleotides, or at least about 100 to about 10,000 nucleotides, or at least about 400 to about 8,000 nucleotides, or at least about 600 to about 5000 nucleotides, or at least about 1000 to about 2000 nucleotides. The donor template sequence may comprise certain sequence differences as compared to the genomic sequence; e.g., restriction sites, nucleotide polymorphisms, selectable markers (e.g., drug resistance genes, fluorescent proteins, enzymes etc.), etc., which may be used to assess for successful insertion of the donor nucleic acid at the cleavage site or in some cases may be used for other purposes (e.g., to signify expression at the targeted genomic locus). Alternatively, these sequence differences may include flanking recombination sequences such as FLPs, loxP sequences, or the like, that can be activated at a later time for removal of the marker sequence. In another embodiment, the donor template comprises a nucleic acid encoding at least a portion of a target gene wherein the donor template nucleic acid comprises all or a portion of the wild-type sequence compared to the target gene comprising a mutation, wherein the donor template is inserted into the target nucleic acid of the cell by HDR during the gene editing process. In such cases, upon insertion into the target nucleic acid, the target gene is corrected such that the functional gene product can be expressed.

In some embodiments, each of the individual nucleic acids are incorporated into plasmid vectors appropriate for transfection into a eukaryotic packaging host cell, examples of which are detailed more fully, below, such that the XDP system will involve two, three, four, or five plasmids. In some embodiments, wherein a first and a second gRNA variant is utilized for XDP having two different RNPs targeting different regions of a target nucleic acid or different genes, the first and a second gRNA variant (with different targeting sequences) are encoded on a single plasmid. In other embodiments, wherein a first and a second gRNA variant is utilized for XDP having two different RNPs targeting different regions of a target nucleic acid or different genes, the first and a second gRNA variant (with different targeting sequences) are encoded on separate plasmids, in which case the XDP system would have up to 6 plasmids. In each case, the nucleotide sequence encoding the components of the XDP system are operably linked to (under the control of) accessory elements and promoters operable in a eukaryotic cell and appropriate for the component to be expressed. Non-limiting examples of Pol II promoters include, but are not limited to EF-1alpha, EF-1alpha core promoter, Jens Tornoe (JeT), promoters from cytomegalovirus (CMV), CMV immediate early (CMVIE), CMV enhancer, herpes simplex virus (HSV) thymidine kinase, early and late simian virus 40 (SV40), the SV40 enhancer, long terminal repeats (LTRs) from retrovirus, mouse metallothionein-I, adenovirus major late promoter (Ad MLP), CMV promoter full-length promoter, the minimal CMV promoter, the chicken β-actin promoter (CBA), CBA hybrid (CBh), chicken β-actin promoter with cytomegalovirus enhancer (CB7), chicken beta-Actin promoter and rabbit beta-Globin splice acceptor site fusion (CAG), the rous sarcoma virus (RSV) promoter, the HIV-Ltr promoter, the hPGK promoter, the HSV TK promoter, a 7SK promoter, the Mini-TK promoter, the human synapsin I (SYN) promoter which confers neuron-specific expression, beta-actin promoter, super core promoter 1 (SCP1), the Mecp2 promoter for selective expression in neurons, the minimal IL-2 promoter, the Rous sarcoma virus enhancer/promoter (single), the spleen focus-forming virus long terminal repeat (LTR) promoter, the TBG promoter, promoter from the human thyroxine-binding globulin gene (Liver specific), the PGK promoter, the human ubiquitin C promoter (UBC), the UCOE promoter (Promoter of HNRPA2B1-CBX3), the synthetic CAG promoter, the Histone H2 promoter, the Histone H3 promoter, the U1a1 small nuclear RNA promoter (226 nt), the U1a1 small nuclear RNA promoter (226 nt), the U1b2 small nuclear RNA promoter (246 nt) 26, the GUSB promoter, the CBh promoter, rhodopsin (Rho) promoter, silencing-prone spleen focus forming virus (SFFV) promoter, a human H1 promoter (H1), a POL1 promoter, the TTR minimal enhancer/promoter, the b-kinesin promoter, mouse mammary tumor virus long terminal repeat (LTR) promoter, the human eukaryotic initiation factor 4A (EIF4A1) promoter, the ROSA26 promoter, the glyceraldehyde 3-phosphate dehydrogenase (GAPDH) promoter, tRNA promoters, and truncated versions and sequence variants of the foregoing. In a particular embodiment, the Pol II promoter is EF-1alpha, wherein the promoter enhances transfection efficiency, the transgene transcription or expression of the CRISPR nuclease, the proportion of expression-positive clones and the copy number of the episomal vector in long-term culture. Non-limiting examples of Pol III promoters include, but are not limited to U6, mini U6, U6 truncated promoters, 7SK, and H1 variants, BiH1 (Bidirectional H1 promoter), BiU6, Bi7SK, BiH1 (Bidirectional U6, 7SK, and H1 promoters), gorilla U6, rhesus U6, human 7SK, human H1 promoters, and truncated versions and sequence variants thereof. In the foregoing embodiment, the Pol III promoter enhances the transcription of the gRNA.

Recombinant expression vectors of the disclosure can also comprise accessory elements that facilitate robust expression of the CasX proteins and the gRNA of the disclosure. For example, recombinant expression vectors can include one or more of a polyadenylation signal (Poly(A), an intronic sequence or a post-transcriptional regulatory element such as a woodchuck hepatitis post-transcriptional regulatory element (WPTRE). Exemplary poly(A) sequences include hGH poly(A) signal (short), HSV TK poly(A) signal, synthetic polyadenylation signals, SV40 poly(A) signal, β-globin poly(A) signal and the like. A person of ordinary skill in the art will be able to select suitable elements to include in the recombinant expression vectors described herein.

In some embodiments, the XDP system of the disclosure comprises two nucleic acids. In some embodiments, the XDP system of the disclosure comprises three nucleic acids. In some embodiments, the XDP system of the disclosure comprises four nucleic acids. In some embodiments, the XDP system of the disclosure comprises five nucleic acids. Exemplary embodiments of the nucleic acids (and plasmids) and the configuration of the components encoded by each the nucleic acids are presented in Table 11, as well as in the Examples, below. It will be understood that in each case, the CasX, the gRNA, the NCR protein, and the tropism factor of the table can comprise any of the embodiments described herein.

VII. XDP PACKAGING CELLS

In another aspect, the present disclosure relates to eukaryotic packaging host cells utilized in the production of XDP. It has been discovered that components derived, in part, from retroviruses can be utilized to create XDP within packaging host cells for delivery of the therapeutic payload to the target cells. In some embodiments, the packaging host cell transformed with the XDP system plasmids produce XDP that facilitate delivery of the encapsidated RNP of a CRISPR Class 2 nuclease and a gRNA CasX:gRNA system to cells to effect editing or modification of a target nucleic acid in a cell. In a particular embodiment, the packaging host cell transformed with the XDP system plasmids produce XDP that facilitate delivery of the encapsidated RNP of a CasX:gRNA system to cells to effect editing or modification of a target nucleic acid in a cell. As used herein, the term "packaging host cell" is used in reference to cell lines that do not contain a packaging signal, but do stably or transiently express viral structural proteins and replication enzymes (e.g., Gag, protease, etc.) which are necessary or useful for the correct packaging of XDP particles. In the embodiments, the cell line can be any cell line suitable for the production of XDP, including primary ex vivo cultured cells (from an individual organism) as well as established cell lines. Cell types may include bacterial cells, yeast cells, and mammalian cells. Exemplary bacterial cell types may include *E. coli*. Exemplary yeast cell types may include *Saccharomyces cerevisiae*. Exemplary mammalian cell types may include mouse, hamster, and human primary cells, as well as cell lines such as human embryonic kidney 293 (HEK293) cells, Lenti-X 293T cells, baby hamster kidney (BHK) cells, HepG2 cells, Saos-2 cells, HuH7 cells, NS0 cells, SP2/0 cells, YO myeloma cells, A549 cells, P3X63 mouse myeloma cells, PER cells, PER.C6 cells, hybridoma cells, VERO cells, NIH3T3 cells, COS cells, WI38 cells, MRCS cells, A549 cells, HeLa cells, Chinese hamster ovary (CHO) cells, or HT1080 cells. The choice of the appropriate vector for the cell type will be readily apparent to the person of ordinary skill in the art. In some embodiments, the packaging host cell can be modified to reduce or eliminate cell surface markers or receptors that would otherwise be incorporated into the XDP, thereby reducing an immune response to the cell surface markers or receptors by the subject receiving an administration of the XDP. Such markers can include receptors or proteins capable of being bound by MHC receptors or that would otherwise trigger an immune response in a subject. In some embodiments, the packaging host cell is modified to reduce or eliminate the expression of a cell surface marker selected from the group consisting of B2M, CIITA, PD1, and HLA-E, wherein the incorporation of the marker is reduced on the surface of the XDP. In some embodiments, the packaging host cell is modified to express one or more cell surface markers selected from the group consisting of CD46, CD47, CD55, CD59, CD24, CD58, SLAMF4, and SLAMF3 (serving as "don't eat me" signals), wherein the cell surface marker is incorporated onto the surface of the XDP, wherein said incorporation disables XDP engulfment and phagocytosis by host surveillance cells such as macrophages and monocytes.

In some embodiments of the XDP system, vectors are introduced into the packaging host cell that comprise nucleic acid sequences that encode the particular therapeutic payload (e.g., a CasX:gRNA designed for editing target nucleic acid), as well as the other viral-derived structural components, detailed above, (e.g., the Gag polyprotein, the Gag-TM-PR polyprotein, the tropism factor, and, optionally, the donor template nucleic acid sequence). The vectors can remain as extra-chromosomal elements or some or all can be integrated into the host cell chromosomal DNA to create a stably-transformed packaging cell.

In some embodiments, the vectors comprising the nucleic acids of the XDP system are introduced into the cell via transfection, transduction, lipofection or electroporation to generate a packaging host cell line. The introduction of the vectors can use one or more of the commercially available TransMessenger reagents from Qiagen, Stemfect RNA Transfection Kit from Stemgent, and TransIT-mRNA Transfection Kit from Minis Bio LLC, Lonza nucleofection, Maxagen electroporation and the like. Methods for transfection, transduction or infection are well known to those of skill in the art.

In some cases, the vectors are introduced into the cells together with a dominant selectable marker, such as neo, DHFR, Gln synthetase or ADA, followed by selection in the presence of the appropriate drug and isolation of clones. A selectable marker gene can be linked physically to genes encoding by the packaging vector.

Assembly and release of XDP with the encapsidated therapeutic payload from the transfected host cell can be mediated by the viral structural protein, Gag. Human immunodeficiency virus type 1 (HIV-1) Gag is synthesized as a precursor polyprotein, Pr55$^{gag}$. This polyprotein is comprised of four major structural domains, which are cleaved by the viral protease into p17 matrix (MA), p24 capsid (CA), p7 nucleocapsid (NC), and p6, during or immediately after the budding process (Adamson C S., and Freed E O. Human immunodeficiency virus type 1 assembly, release, and maturation. Adv. Pharmacol. 55:347 (2007)). Utilizing an HIV-1 system, it is sufficient to express the p55 Gag protein to allow the efficient production of XDPs from cells (Gheysen et al., Assembly and release of HIV-1 precursor Pr55Gag virus-like particles from recombinant baculovirus-infected insect cells. Cell. 59(1):103 (1989)). In the context of the uncleaved Pr55$^{Gag}$, MA constitutes the N-terminal domain of the Gag protein and is essential for membrane binding and localization of the Gag precursor to the plasma membrane. CA and NC domains promote Gag multimerization through direct protein-protein interactions and indirect RNA-mediated interactions, respectively. Inclusion of the late domain motif within p6 can promote release of XDP particles from the cell surface. Upon expression, the Gag polypeptide is targeted to the cell membrane and incorporated in the XDP during membrane budding. During or shortly after virus budding from the host cell, the HIV-1 protease cleaves Pr55gag into the mature Gag proteins p17 matrix (MA), p24 capsid (CA), p7 nucleocapsid (NC), and p6. The proteolytic processing of Gag results in a major transformation in XDP structure: MA remains associated with the inner face of the viral membrane, whereas CA condenses to form a shell around the NC complex (if incorporated). This rearrangement produces a morphological transition to an XDP particle with a conical core characteristic similar to an infectious virion, incorporating the therapeutic payload within the particle and the tropism factor on the surface of the particle.

VIII. XDP EXPRESSION SYSTEMS AND METHODS OF PRODUCING XDP

In another aspect, the present disclosure provides a recombinant expression system for use in the production of XDP in a selected host packaging cell, comprising one or more expression cassettes comprising the nucleic acids of the XDP system described herein operably linked to promoters and accessory elements compatible with expression in the selected host cell. The expression cassettes may be included on one or more vectors as described herein and in the Examples, and may use the same or different promoters. Exemplary accessory elements include a transcription promoter, MMLV-ltr trans-activator, internal ribosome entry site (IRES) or p2A peptide to permit translation of multiple genes from a single transcript, metallothionein, a transcription enhancer element, a transcription termination signal, polyadenylation sequences, sequences for optimization of initiation of translation, and translation termination sequences. It will be understood that the choice of the appropriate control element will depend on the encoded component to be expressed (e.g., protein or RNA) or whether the nucleic acid comprises multiple components that require different polymerases or are not intended to be expressed as a fusion protein.

In some embodiments, a nucleotide sequence encoding each therapeutic payload (e.g., a gRNA, gRNA variant or a CasX or CasX variant protein) is operably linked to an inducible promoter, a constitutively active promoter, a spatially restricted promoter (i.e., transcriptional control element, enhancer, tissue specific promoter, cell type specific promoter, etc.), or a temporally restricted promoter. In certain embodiments, suitable promoters can be derived from viruses and can therefore be referred to as viral promoters, or they can be derived from any organism, including prokaryotic or eukaryotic organisms. In other embodiments, individual nucleotide sequences encoding the gRNA or the CasX are linked to one of the foregoing categories of promoters, which are then introduced into the cells to be modified by conventional methods, described below.

Non-limiting examples of Pol II promoters include, but are not limited to UBC, CMV, SV40, CAG, CB7, PGK, JeT, GUSB, CBh, EF-1 alpha, beta-actin, RSV, SFFV, CMVd1 promoter, truncated human CMV (tCMVd2), minimal CMV promoter, chicken β-actin promoter, HSV TK promoter, Mini-TK promoter, minimal IL-2 promoter, GRP94 promoter, Super Core Promoter 1, Super Core Promoter 2, MLC, MCK, GRK1 protein promoter, Rho promoter, and CAR protein promoter, hSyn Promoter, U1A promoter, Ribosomal Rp1 and Rps promoters (Examples hRp130 and hRps18), CMV53 promoter, minimal SV40 promoter, CMV53 promoter, SFCp promoter, pJB42CAT5 promoter, MLP promoter, EFS promoter, MeP426 promoter, MecP2 promoter, MHCK7 promoter, CK7 promoter, and CK8e promoter. In a particular embodiment, the Pol II promoter is EF-1alpha, wherein the promoter enhances transfection efficiency, the transgene transcription or expression of the CRISPR nuclease, the proportion of expression-positive clones and the copy number of the episomal vector in long-term culture.

Non-limiting examples of Pol III promoters include, but are not limited to U6, mini U6, 7SK, and H1 variants, BiH1 (Bidirectional H1 promoter), BiU6, Bi7SK, BiH1 (Bidirectional U6, 7SK, and H1 promoters), gorilla U6, rhesus U6, human 7SK, and human H1 promoters. In the foregoing embodiment, the Pol III promoter enhances the transcription of the gRNA. Selection of the appropriate promoter is well within the level of ordinary skill in the art, as it relates to controlling expression, e.g., for modifying a gene or other target nucleic acid.

In some embodiments, the present disclosure provides methods of making an XDP comprising a therapeutic payload (e.g., an RNP of a CasX variant protein and a gRNA variant or two types of RNPs of a CasX variant protein and a first and a second gRNA variant with different targeting sequences and/or scaffolds), the method comprising propagating the packaging host cell of the embodiments described herein comprising the expression cassettes or the integrated nucleic acids encoding the XDP systems of any one of the embodiments described herein under conditions such that XDPs are produced with the encapsidated therapeutic payload, followed by harvesting the XDPs produced by the packaging host cell, as described below or in the Examples. In some embodiments, the packaging host cell produces XDP comprising RNP of a CasX variant and gRNA variant and, optionally, a donor template for the editing or modification of the target nucleic acid.

The packaging host cell can be, for example, a mammalian cell (e.g., Baby Hamster Kidney fibroblast (BHK) cells, human embryonic kidney 293 (HEK293), human embryonic kidney 293T (HEK293T), NS0 cells, SP2/0 cells, YO myeloma cells, P3X63 mouse myeloma cells, PER cells, PER.C6 cells, hybridoma cells, NIH3T3 cells, CV-1 (simian) in Origin with SV40 genetic material (COS), HeLa, Chinese hamster ovary (CHO), HT1080, Vero, or yeast cells, or other eukaryotic cells known in the art suitable for the production of recombinant products), an insect cell (e.g., *Trichoplusia ni* (Tn5) or Sf9), a bacterial cell, a plant cell, a yeast cell, an antigen presenting cell (e.g., primary, immortalized or tumor-derived lymphoid cells such as macrophages, monocytes, dendritic cells, B-cells, T-cells, stem cells, and progenitor cells thereof). Packaging cells can be transfected by conventional methods, including electroporation, use of cationic polymers, calcium phosphate, virus-mediated transfection, transduction, or lipofection. In some embodiments, the packaging host cell can be modified to reduce or eliminate cell surface markers or receptors that would otherwise be incorporated into the XDP, thereby reducing an immune response to the cell surface markers or receptors by the subject receiving an administration of the XDP. In some embodiments, the packaging host cell is modified to reduce the expression of a cell surface marker selected from the group consisting of B2M, CIITA, PD1, and HLA-E, wherein the incorporation of the marker is reduced or eliminated on the surface of the XDP. In some embodiments, the packaging host cell is modified to express one or more cell surface markers selected from the group consisting of CD46, CD47, CD55, CD59, CD24, CD58, SLAMF4, and SLAMF3 (serving as "don't eat me" signals), wherein the cell surface marker is incorporated onto the surface of the XDP, wherein said incorporation disables XDP engulfment and phagocytosis by host surveillance cells such as macrophages and monocytes.

The introduction of the vectors into the packaging host cell can use one or more of the commercially available TransMessenger reagents from Qiagen, Stemfect RNA Transfection Kit from Stemgent, and TransIT-mRNA Transfection Kit from Minis Bio LLC, Lonza nucleofection, Maxagen electroporation and the like. Methods for transfection, transduction or infection are well known to those of skill in the art.

In one embodiment, XDP are produced by the incubation of the transfected packaging host cells in appropriate growth medium for at least 48 to 72-120 hours under conditions to promote expression and assembly of the XDP, and are collected and concentrated for use in the methods described herein. In some cases, the XDP can be further concentrated by centrifugation in a 10% or a 10-30% density gradient sucrose buffer. In other cases, the XDP can be concentrated by column chromatography, such as by use of an ion-exchange resin or a size exclusion resin.

IX. APPLICATIONS

The XDP systems provided herein are useful in methods for delivery of the therapeutic payload to a cell. In some embodiments, the disclosure provides methods of delivery of the XDP systems comprising RNP of CRISPR class 2 nucleases and gRNA provided herein for modifying or editing target nucleic acids in cells. In a particular embodiment, the disclosure provides methods of delivery of the XDP systems comprising RNP of a CasX variant and gRNA variant of any of the embodiments provided herein for modifying or editing target nucleic acids in cells. In some embodiments of the method, the method utilizes any of the XDP embodiments comprising RNPs the CasX:gRNA systems described herein, and optionally includes a donor template embodiment described herein. In some cases, the method knocks-down the expression of a mutant protein in cells comprising the target nucleic. In other cases, the method knocks-out the expression of the mutant protein. In still other cases, the method results in the correction of the mutation in the target nucleic acid, resulting in the expression of a functional gene product. In some embodiments, the method utilizes an XDP system in which the XDP particles encompass two types of RNPs wherein a second gRNA targets a different region of the target nucleic acid or a different gene compared to the first gRNA.

In some embodiments, the method comprises contacting the cells comprising the target nucleic acid with an effective dose of XDPs comprising RNPs of CasX variant protein and a gRNA variant comprising a targeting sequence complementary to the target nucleic acid, wherein said contacting results in modification of the target nucleic acid by the CasX variant protein. In another embodiment, the XDP further comprises a donor template wherein the contacting of the cell with the XDP results in insertion of the donor template into the target nucleic acid sequence. In some cases, the donor template is used in conjunction with the RNP to correct a mutation in the target nucleic acid gene, while in other cases the donor template is used to insert a mutation to knock-down or knock-out expression of the expression product of the target nucleic acid gene.

In some embodiments, the method of modifying a target nucleic acid in a cell comprises contacting the cells comprising the target nucleic acid with an effective dose of XDPs wherein the cell is modified in vitro or ex vivo.

In other embodiments of the method of modifying a target nucleic acid in a cell, the cells are modified in vivo, wherein a therapeutically-effective dose of the XDP is administered to a subject. The method has the advantage over viral delivery systems in that the RNP are comparatively short-lived relative to the nucleic acids delivered in viral systems such as AAV. A further advantage of the XDP system is the ability to match the system to specific cell types by manipulating the tropism of the XDP. In some embodiments, the half-life of the delivered RNP in a subject is about 24 h, or about 48 h, or about 72 h, or about 96 h, or about 120 h, or about 1 week. By the methods of treatment, the administration of the XDP results in the improvement of one, two, or more symptoms, clinical parameters or endpoints associated with the disease in the subject. In some embodiments, the subject administered the XDP is selected from the group consisting of mouse, rat, pig, non-human primate, and human. In a particular embodiment, the subject is a human. In one embodiment of the method, the XDP is administered to the subject at a dose of at least about $1 \times 10^5$ XDP particles/kg, or at least about $1 \times 10^6$ particles/kg, or at least about $1 \times 10^7$ particles/kg, or at least about $1 \times 10^8$ particles/kg, or at least about $1 \times 10^9$ particles/kg, or at least about $1 \times 10^{10}$ particles/kg, or at least about $1 \times 10^{11}$ particles/kg, or at least about $1 \times 10^{12}$ particles/kg, or at least about $1 \times 10^{13}$ particles/kg, or at least about $1 \times 10^{14}$ particles/kg, or at least about $1 \times 10^{15}$ particles/kg, or at least about $1 \times 10^{16}$ particles/kg. In other embodiments, the XDP is administered to the subject at a dose of at least about $1 \times 10^5$ particles/kg to at least about $1 \times 10^{16}$ particles/kg. In another embodiment, the XDP is administered to the subject at a dose of at least about $1 \times 10^5$ particles/kg to about $1 \times 10^{16}$ particles/kg, or at least about $1 \times 10^6$ particles/kg to about $1 \times 10^{15}$ particles/kg, or at least about $1 \times 10^7$ particles/kg to about $1 \times 10^{14}$ particles/kg. In one embodiment, the XDP is administered by a route of administration selected from the group consisting of subcutaneous, intradermal, intraneural, intranodal, intramedullary, intramuscular, intravenous, intra-arterial, intracerebroventricular, intracisternal, intrathecal, intracranial, intralumbar, intratracheal, intraosseous, inhalatory, intracontralateral striatum, intraocular, intravitreal, intralymphatical, intraperitoneal routes and sub-retinal routes, wherein the administering method is injection, transfusion, or implantation.

In another embodiment, the disclosure provides a method of treatment of a subject having a disease according to a treatment regimen comprising one or more consecutive doses using a therapeutically effective dose of an XDP of any of the embodiments described herein. In one embodiment of the treatment regimen, the therapeutically effective dose is administered as a single dose. In another embodiment of the treatment regimen, the therapeutically effective dose is administered to the subject as two or more doses over a period of at least two weeks, or at least one month, or at least two months, or at least three months, or at least four months, or at least five months, or at least six months, or once a year, or every 2 or 3 years.

X. KITS AND ARTICLES OF MANUFACTURE

In another aspect, provided herein are kits comprising the compositions of the embodiments described herein. In some embodiments, the kit comprises an XDP comprising a therapeutic payload of any of the embodiment described herein, an excipient and a suitable container (for example a tube, vial or plate). In a particular embodiment, the therapeutic payload is multiple particles of RNP of a CasX variant and a gRNA variant.

In some embodiments, the kit further comprises a buffer, a nuclease inhibitor, a protease inhibitor, a liposome, a therapeutic agent, a label, a label visualization reagent, or any combination of the foregoing. In some embodiments, the kit further comprises a pharmaceutically acceptable carrier, diluent or excipient. In some embodiments, the kit further comprises instructions for use.

The present description sets forth numerous exemplary configurations, methods, parameters, and the like. It should be recognized, however, that such description is not intended as a limitation on the scope of the present disclosure, but is instead provided as a description of exemplary embodiments. Embodiments of the present subject matter described above may be beneficial alone or in combination, with one or more other aspects or embodiments. Without limiting the foregoing description, certain non-limiting embodiments of the disclosure are provided below. As will be apparent to those of skill in the art upon reading this disclosure, each of the individually numbered embodiments may be used or combined with any of the preceding or following individually numbered embodiments. This is intended to provide support for all such combinations of embodiments and is not limited to combinations of embodiments explicitly provided below.

ENUMERATED EMBODIMENTS

The invention can be understood with reference to the following illustrative enumerated embodiments.
Set 1.

1. A delivery particle (XDP) system comprising one or more nucleic acids encoding components of:
   (a) one or more retroviral components;
   (b) one or more therapeutic payloads; and
   (c) a tropism factor.
2. The XDP system of embodiment 1, wherein the therapeutic payload comprises a protein, a nucleic acid, or comprises both a protein and a nucleic acid.
3. The XDP system of embodiment 1 or 2, wherein the therapeutic payload comprises a nucleic acid selected from the group consisting of a single-stranded antisense oligonucleotide (ASOs), a double-stranded RNA interference (RNAi) molecule, a DNA aptamer, an RNA aptamer, a CRISPR guide nucleic acid, a donor template, or any combination thereof.
4. The XDP system of embodiment 2 or embodiment 3, wherein the CRISPR guide nucleic acid is a single-molecule guide RNA comprising a scaffold sequence and a targeting sequence, wherein the targeting sequence comprises between 14 and 30 nucleotides and is complementary to a target nucleic acid sequence.
5. The XDP system of embodiment 4, wherein the targeting sequence has 18, 19 or 20 nucleotides and is complementary to a target nucleic acid sequence.
6. The XDP system of embodiment 4 or embodiment 5, wherein the scaffold sequence comprises a sequence set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.
7. The XDP system of embodiment 4 or embodiment 5, wherein the scaffold sequence comprises a sequence set forth in Table 8.
8. The XDP system of any one of embodiments 3-7, wherein the single-molecule guide RNA further comprises one or more components selected from the group consisting of:
   i) Stem IIB of Rev response element (RRE),
   ii) Stem II-V of RRE;
   iii) Stem II of RRE
   iv) Rev-binding element (RBE) of Stem IIB; and
   v) and full-length RRE,
   wherein the one or more components are capable of binding Rev.
9. The XDP system of any one of embodiments 4-8, wherein the single-molecule guide RNA further comprises one or more binding partner elements selected from the group consisting of:
   i) MS2 hairpin;
   ii) PP7 hairpin;
   iii) Qbeta hairpin;
   iv) Psi packaging signal;
   v) U1 hairpin II; and
   vi) Psi RNA packaging signal.
10. The XDP system of any one of the preceding embodiments, wherein the tropism factor is selected from the group consisting of a glycoprotein, an antibody fragment, a receptor, and a ligand to a target cell marker.
11. The XDP system of embodiment 10, wherein the tropism factor is a glycoprotein having sequence selected from the group consisting of the sequences set forth in Table 9, or is encoded by a sequence set forth in Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.
12. The XDP system of embodiment 10, wherein the tropism factor is a glycoprotein having an selected from the group consisting of the sequences set forth in Table 9, or is encoded by a sequence set forth in Table 65.
13. The XDP system of embodiment 2, wherein the protein payload is selected from the group consisting of a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.
14. The XDP system of embodiment 13, wherein the CRISPR protein is a Class 1 or Class 2 CRISPR protein.

15. The XDP system of embodiment 14, wherein the CRISPR protein is a Class 2 CRISPR protein selected from the group consisting of a Type II, a Type V, or a Type VI protein.

16. The XDP system of embodiment 15, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12j, Cas12k, Cas14, CasPhi, CasBeta, CasLamda, and CasX.

17. The XDP system of embodiment 16, wherein the CRISPR protein is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

18. The XDP system of embodiment 16, wherein the CRISPR protein is a CasX variant comprising a sequence set forth in Table 3.

19. The XDP system of any one of embodiments 3-13, further comprising a protein payload wherein the protein payload is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

20. The XDP system of any one of embodiments 3-13, further comprising a protein payload wherein the protein payload is a CasX variant comprising a sequence set forth in Table 3.

21. The XDP system of any one of embodiments 17-20, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

22. The XDP system of any one of embodiments 17-20, wherein the CasX variant further comprises one or more NLS selected from the group of sequences consisting of the sequences of Table 5, wherein the one or more NLS are located at or near the N-terminus and/or the C-terminus of the CasX variant.

23. The XDP system of any one of the preceding embodiments, wherein the nucleic acids further encode one or more components selected from:
  (a) all or a portion of a retroviral Gag polyprotein;
  (b) MS2 coat protein;
  (c) PP7 coat protein;
  (d) Qbeta coat protein;
  (e) U1A signal recognition particle;
  (f) phage R-loop;
  (g) Rev protein;
  (h) Psi packaging element;
  (i) one or more protease cleavage sites;
  (j) Gag-transframe region-Pol protease polyprotein (Gag-TFR-PR);
  (k) a retroviral Gag-Pol polyprotein; and
  (l) a protease capable of cleaving the one or more protease cleavage sites.

24. The XDP system of any one of the preceding embodiments, wherein one or more of the retroviral components are derived from an Orthoretrovirinae virus or a Spumaretrovirinae virus.

25. The XDP system of embodiment 24, wherein the Orthoretrovirinae virus is selected from the group consisting of an Alpharetrovirus, Betaretrovirus, Deltaretrovirus, Epsilonretrovirus, Gammaretrovirus, and Lentivirus.

26. The XDP system of embodiment 24, wherein the Spumaretrovirinae virus is selected from the group consisting of Bovispumavirus, Equispumavirus, Felispumavirus, Prosimiispumavirus, Simiispumavirus, or Spumavirus.

27. The XDP system of any one of the preceding embodiments, wherein
  (a) the components are encoded on a single nucleic acid;
  (b) the components are encoded on two nucleic acids;
  (c) the components are encoded on three nucleic acids;
  (d) the components are encoded on four nucleic acids; or
  (e) the components are encoded on five nucleic acids.

28. The XDP system of embodiment 27, wherein the one or more of the components encoded by the nucleic acids are configured according to any one of FIG. 16, 45-54, 67, 68, 83, 90-92, 118, or 137.

29. The XDP system of embodiment 27 or embodiment 28, wherein the one or more of the retroviral components are encoded by a nucleic acid selected from the group of sequences consisting of the sequences set forth in Table 10.

30. The XDP system of any one of the preceding embodiments, wherein the components are capable of self-assembling into an XDP when the one or more nucleic acids are introduced into a eukaryotic packaging cell and the components are expressed.

31. The XDP of embodiment 30, wherein the therapeutic payloads are encapsidated within the XDP upon self-assembly of the XDP in the eukaryotic packaging cell.

32. The XDP system of embodiment 31, wherein the therapeutic payload comprises the CasX variant and the guide RNA complexed as a ribonucleoprotein complex (RNP) and, optionally, a donor template.

33. The XDP system of embodiment 32, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

34. The XDP system of embodiment 32, wherein the one or more binding partner elements incorporated into the guide RNA are capable of binding an expressed packaging recruiter incorporated into the Gag polyprotein selected from the group consisting of MS2 coat protein, PP7 coat protein, Q□ coat protein, nucleocapsid protein, and U1A signal recognition particle, wherein the binding facilitates the incorporation of the RNP into the XDP during self-assembly.

35. The XDP system of embodiment 34, wherein incorporation of the one or more binding partner elements and the packaging recruiter results in at least a 2-fold, at a least 3-fold, at least a 4-fold, at least a 5-fold increase in editing potency of the XDP for the target nucleic acid compared to XDP without the one or more binding partner elements and the packaging recruiter, when assayed in vitro under comparable conditions.

36. The XDP of any one of embodiments 30-35, wherein the tropism factor is incorporated on the XDP surface upon self-assembly of the XDP in the eukaryotic packaging cell.

37. The XDP system of embodiment 35, wherein the tropism factor has binding affinity for a cell surface marker of a target cell and facilitates entry of the XDP into the target cell.

38. The XDP system of embodiment 36 or embodiment 37, wherein incorporation of the glycoprotein results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

39. The XDP system of any one of embodiments 32-38, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

40. An XDP system comprising one or more nucleic acids encoding components:
(a) all or a portion of an Alpharetrovirus Gag polyprotein;
(b) one or more therapeutic payloads; and
(c) a tropism factor.

41. The XDP system of embodiment 40, wherein the Gag polyprotein comprises one or more components selected from the group consisting of a matrix polypeptide (MA), a P2A peptide, a P2B peptide, a P10 peptide, a capsid polypeptide (CA), and a nucleocapsid polypeptide (NC).

42. The XDP system of embodiment 41, wherein the Gag polyprotein comprises, from N-terminus to C-terminus, a matrix polypeptide (MA), a P2A peptide, a P2B peptide, a P10 peptide, a capsid polypeptide (CA), and a nucleocapsid polypeptide (NC).

43. The XDP system of any one of embodiments 40-42, wherein the one or more nucleic acids further encode one or more components selected from
(a) HIV p1 peptide;
(b) HIV p6 peptide;
(c) HIV Gag-Pol polyprotein;
(d) MS2 coat protein;
(e) PP7 coat protein;
(f) Qbeta coat protein;
(g) Psi packaging element;
(h) U1A signal recognition particle;
(i) phage R-loop;
(j) Rev protein;
(k) one or more protease cleavage sites;
(l) a protease capable of cleaving the cleavage sites; and
(m) Gag-transframe region-Pol protease polyprotein.

44. The XDP system of any one of embodiments 40-43, wherein the tropism factor is selected from the group consisting of a glycoprotein, an antibody fragment, a receptor, and a ligand to a target cell marker.

45. The XDP system of embodiment 44, wherein the tropism factor is a glycoprotein having sequence selected from the group consisting the sequences set forth in Table 9, a or is encoded by a sequence set forth in Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

46. The XDP system of embodiment 44, wherein the tropism factor is a glycoprotein having sequence selected from the group of sequences consisting of the sequences set forth in Table 5, or is encoded by a sequence set forth in Table 65.

47. The XDP system of embodiment 44, wherein the tropism factor is glycoprotein G from vesicular stomatitis virus (VSV-G).

48. The XDP system of embodiment 47, wherein the VSV-G has a sequence selected from the group consisting of the sequences of Table 10.

49. The XDP system of any one of embodiments 40-48, wherein the therapeutic payload comprises a protein, a nucleic acid, or comprises both a protein and a nucleic acid.

50. The XDP system of embodiment 49, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

51. The XDP system of embodiment 50, wherein the CRISPR protein is a Class 1 or Class 2 CRISPR protein.

52. The XDP system of embodiment 51, wherein the CRISPR protein is a Class 2 CRISPR protein selected from the group consisting of Type II, Type V, or Type VI protein.

53. The XDP system of embodiment 52, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12j, Cas12k, Cas14, CasPhi, CasBeta, CasLamda, and CasX.

54. The XDP system of embodiment 53, wherein the CRISPR protein is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

55. The XDP system of embodiment 53, wherein the CRISPR protein is a CasX variant comprising a sequence set forth in Table 3.

56. The XDP system of embodiment 54 or embodiment 55, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO:

96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

57. The XDP system of embodiment 54 or embodiment 55, wherein the CasX variant further comprises one or more NLS selected from the group of sequences consisting of the sequences of Table 5, wherein the one or more NLS are located at or near the N-terminus and/or the C-terminus of the CasX variant.

58. The XDP system any one of embodiments 40-48, wherein the therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

59. The XDP system of any one of embodiments 50-57, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

60. The XDP system of embodiment 59, wherein the CRISPR guide nucleic acid is a single-molecule guide RNA comprising a scaffold sequence and a targeting sequence, wherein the targeting sequence is complementary to a target nucleic acid sequence.

61. The XDP system of embodiment 59, wherein the single-molecule guide RNA further comprises one or more components selected from the group consisting of:
  i) Stem IIB of Rev response element (RRE),
  ii) Stem II-V of RRE;
  iii) Stem II of RRE
  iv) Rev-binding element (RBE) of Stem IIB; and
  v) and full-length RRE,
  wherein the one or more components are capable of binding Rev.

62. The XDP system of embodiment 60 or embodiment 61, wherein the single-molecule guide RNA further comprises one or more binding partner elements selected from the group consisting of:
  i) MS2 hairpin;
  ii) PP7 hairpin;
  iii) Qbeta hairpin; and
  iv) U1 hairpin II.

63. The XDP system of any one of embodiments 59-62, wherein the scaffold sequence comprises a sequence set forth in Table 8 or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

64. The XDP system of any one of embodiments 59-62, wherein the scaffold sequence of the guide RNA comprises a sequence set forth in Table 8.

65. The XDP system of any one of embodiments 59-64, wherein the targeting sequence of the guide RNA consists of 14, 15, 16, 17, 18, 19, 20, 21, 22, 23, 24, 25, 26, 27, 28, 29, or 30 consecutive nucleotides.

66. The XDP system of embodiment 65, wherein the targeting sequence has 18, 19 or 20 nucleotides and is complementary to a target nucleic acid sequence.

67. The XDP system of any one of embodiments 40-66, wherein
  (a) the components are encoded on a single nucleic acid;
  (b) the components are encoding on two nucleic acids;
  (c) the components are encoding on three nucleic acids;
  (d) the components are encoding on four nucleic acids; or
  (e) the components are encoding on five nucleic acids.

68. The XDP system of embodiment 66, wherein the one or more of the components encoded by the nucleic acids are configured according to any one of the configurations in Table 11.

69. The XDP system of embodiment 67 or embodiment 68, wherein the one or more of the components are encoded by nucleic acids selected from the group of sequences set forth in Tables 10, 12, 16, 17, 19, 20, 21, 24, 27, 30, 34, 35, 38, 40, 42, 43, 46, 47, 48, 51, 52, 54, 57, 58, 60, 62, 65, 66, 68, 69, 72, 73, 78, 80, 83, 87, 88, 90 and 104, or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

70. The XDP system of any one of embodiments 40-69, wherein the components are capable of self-assembling into an XDP when the one or more nucleic acids are introduced into a eukaryotic packaging cell and the components are expressed.

71. The XDP of embodiment 70, wherein the therapeutic payload is encapsidated within the XDP upon self-assembly of the XDP in the eukaryotic packaging cell.

72. The XDP system of embodiment 71, wherein the therapeutic payload comprises the CasX variant and the guide RNA complexed as a ribonucleoprotein complex (RNP) and, optionally, a donor template.

73. The XDP system of embodiment 72, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

74. The XDP system of any one of embodiments 62-73, wherein the one or more binding partner elements incorporated into the guide RNA are capable of binding an expressed packaging recruiter incorporated into the Gag polypeptide selected from the group consisting of MS2 coat protein, PP7 coat protein, Qbeta coat protein, nucleocapsid protein, and U1A signal recognition particle, wherein the binding facilitates the incorporation of the RNP into the XDP during self-assembly.

75. The XDP system of embodiment 74, wherein incorporation of the one or more binding partner elements and the packaging recruiter results in at least a 2-fold, at a least 3-fold, at least a 4-fold, at least a 5-fold increase in editing potency of the XDP for the target nucleic acid compared to XDP without the one or more binding partner elements and the packaging recruiter, when assayed in vitro under comparable conditions.

76. The XDP of any one of embodiments 70-73, wherein the tropism factor is incorporated on the XDP surface upon self-assembly of the XDP in the eukaryotic packaging cell.

77. The XDP system of embodiment 76, wherein the tropism factor has binding affinity for a cell surface marker of a target cell and facilitates entry of the XDP into the target cell.

78. The XDP system of embodiment 76 or embodiment 77, wherein incorporation of the glycoprotein results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

79. The XDP system of any one of embodiments 72-78, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

80. An XDP system comprising one or more nucleic acids encoding components:
  (a) all or a portion of an Betaretrovirus Gag polyprotein;
  (b) one or more therapeutic payloads; and
  (c) a tropism factor.

81. The XDP system of embodiment 80, wherein the Gag polyprotein comprises one or more components selected from the group consisting of a matrix polypeptide (MA), a PP21/24 peptide, a P12/P3/P8 peptide, a capsid polypeptide (CA), and a nucleocapsid polypeptide (NC).

82. The XDP system of embodiment 81, wherein the Gag polyprotein comprises components, from N-terminus to C-terminus, a matrix polypeptide (MA), a PP21/24 peptide, a P12/P3/P8 peptide, a capsid polypeptide (CA), and a nucleocapsid polypeptide (NC) and, optionally, a protease cleavage site between components.

83. The XDP system of any one of embodiments 80-82, wherein the nucleic acids further encode one or more components selected from
  (a) HIV p1 peptide;
  (b) HIV p6 peptide;
  (c) HIV Gag-Pol polyprotein;
  (d) MS2 coat protein;
  (e) PP7 coat protein;
  (f) Qbeta coat protein;
  (g) Psi packaging element;
  (h) U1A signal recognition particle;
  (i) phage R-loop;
  (j) Rev protein;
  (k) one or more protease cleavage sites;
  (l) a protease capable of cleaving the cleavage sites; and
  (m) Gag-transframe region-Pol protease polyprotein.

84. The XDP system of any one of embodiments 80-83, wherein the tropism factor is selected from the group consisting of a glycoprotein, an antibody fragment, a receptor, and a ligand to a target cell marker.

85. The XDP system of embodiment 84, wherein the tropism factor is a glycoprotein comprising a sequence selected from the group consisting of the sequences set forth in Table 9 or encoded by a sequence of Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

86. The XDP system of embodiment 84, wherein the tropism factor is a glycoprotein comprising a sequence selected from the group consisting of the sequences set forth in Table 9 or encoded by a sequence of Table 65.

87. The XDP system of embodiment 86, wherein the tropism factor is glycoprotein G from vesicular stomatitis virus (VSV-G).

88. The XDP system of embodiment 87, wherein the VSV-G has a sequence selected from the group consisting of the sequences of Table 9.

89. The XDP system of any one of embodiments 80-88, wherein the therapeutic payload comprises a protein, a nucleic acid, or comprises both a protein and a nucleic acid.

90. The XDP system of embodiment 89, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

91. The XDP system of embodiment 90, wherein the CRISPR protein is a Class 1 or Class 2 CRISPR protein.

92. The XDP system of embodiment 91, wherein the CRISPR protein is a Class 2 CRISPR protein selected from the group consisting of Type II, Type V, or Type VI protein.

93. The XDP system of embodiment 92, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12j, Cas12k, Cas14, CasPhi, CasBeta, CasLamda, and CasX.

94. The XDP system of embodiment 93, wherein the CRISPR protein is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

95. The XDP system of embodiment 93, wherein the CRISPR protein is a CasX variant comprising a sequence set forth in Table 3.

96. The XDP system of embodiment 94 or embodiment 95, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

97. The XDP system any one of embodiments 80-88, wherein the therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

98. The XDP system of any one of embodiments 90-97, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

99. The XDP system of embodiment 98, wherein the CRISPR guide nucleic acid is a single-molecule guide RNA comprising a scaffold sequence and a targeting sequence, wherein the targeting sequence is complementary to a target nucleic acid sequence.

100. The XDP system of embodiment 99, wherein the single-molecule guide RNA further comprises one or more components selected from the group consisting of:
  i) Stem IIB of Rev response element (RRE),
  ii) Stem II-V of RRE;
  iii) Stem II of RRE
  iv) Rev-binding element (RBE) of Stem IIB; and
  v) and full-length RRE,
  wherein the one or more components are capable of binding Rev.

101. The XDP system of embodiment 99 or embodiment 100, wherein the single-molecule guide RNA further comprises one or more binding partner elements selected from the group consisting of:
  i) MS2 hairpin;
  ii) PP7 hairpin;
  iii) Psi packaging signal;
  iv) Qbeta hairpin; and
  v) U1 hairpin II.

102. The XDP system of any one of embodiments 99-101, wherein the scaffold sequence comprises a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

103. The XDP system of any one of embodiments 95-101, wherein the scaffold sequence of the guide RNA comprises a sequence selected from the group consisting of the sequences set forth in Table 8.

104. The XDP system of any one of embodiments 98-103, wherein the targeting sequence of the guide RNA consists of 14, 15, 16, 17, 18, 19, 20, 21, 22, 23, 24, 25, 26, 27, 28, 29, or 30 consecutive nucleotides.

105. The XDP system of embodiment 104, wherein the targeting sequence has 18, 19 or 20 nucleotides and is complementary to a target nucleic acid sequence.

106. The XDP system of any one of embodiments 80-105, wherein
  (a) the components are encoded on a single nucleic acid;
  (b) the components are encoding on two nucleic acids;
  (c) the components are encoding on three nucleic acids;
  (d) the components are encoding on four nucleic acids; or
  (e) the components are encoding on five nucleic acids.

107. The XDP system of embodiment 106, wherein the one or more of the components encoded by the nucleic acids are configured according to any one of the configurations in Table 11.

108. The XDP system of embodiment 106 or embodiment 107, wherein the one or more of the components are encoded by nucleic acids selected from the group of sequences consisting of the sequences set forth in Tables 10, 12, 16, 17, 19, 20, 21, 24, 27, 30, 34, 35, 38, 40, 42, 43, 46, 47, 48, 51, 52, 54, 57, 58, 60, 62, 65, 66, 68, 69, 72, 73, 78, 80, 83, 87, 88, 90, and 104 or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

109. The XDP system of any one of embodiments 80-108, wherein the components are capable of self-assembling into an XDP when the one or more nucleic acids are introduced into a eukaryotic packaging cell and the components are expressed.

110. The XDP of embodiment 109, wherein the therapeutic payload is encapsidated within the XDP upon self-assembly of the XDP in the eukaryotic packaging cell.

111. The XDP system of embodiment 110, wherein the therapeutic payload comprises the CasX variant and the guide RNA complexed as a ribonucleoprotein complex (RNP) and, optionally, a donor template.

112. The XDP system of embodiment 111, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

113. The XDP system of any one of embodiments 101-112, wherein the one or more binding partner elements incorporated into the guide RNA are capable of binding an expressed packaging recruiter incorporated into the Gag polypeptide selected from the group consisting of MS2 coat protein, PP7 coat protein, Qbeta coat protein, nucleocapsid, and U1A signal recognition particle, wherein the binding facilitates the incorporation of the RNP into the XDP during self-assembly.

114. The XDP system of embodiment 113, wherein incorporation of the one or more binding partner elements and the packaging recruiter results in at least a 2-fold, at a least 3-fold, at least a 4-fold, at least a 5-fold increase in editing potency of the XDP for the target nucleic acid compared to XDP without the one or more binding partner elements and the packaging recruiter, when assayed in vitro under comparable conditions.

115. The XDP of any one of embodiments 109, wherein the tropism factor is incorporated on the XDP surface upon self-assembly of the XDP in the eukaryotic packaging cell.

116. The XDP system of embodiment 112, wherein the tropism factor has binding affinity for a cell surface marker of a target cell and facilitates entry of the XDP into the target cell.

117. The XDP system of embodiment 115 or embodiment 116, wherein incorporation of the glycoprotein results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

118. The XDP system of any one of embodiments 111-117, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

119. An XDP system comprising one or more nucleic acid encoding components:

(a) all or a portion of an Deltaretrovirus Gag polyprotein;
(b) one or more therapeutic payloads; and
(c) a tropism factor.

120. The XDP system of embodiment 119, wherein the Gag polyprotein comprises one or more components selected from the group consisting of a matrix polypeptide (MA), a capsid polypeptide (CA), and a nucleocapsid polypeptide (NC).

121. The XDP system of embodiment 120, wherein the Gag polyprotein comprises, from N-terminus to C-terminus, matrix polypeptide (MA), a capsid polypeptide (CA), and a nucleocapsid polypeptide (NC).

122. The XDP system of any one of embodiments 119-121, wherein the nucleic acids encode one or more components selected from
(a) HIV p1 peptide;
(b) HIV p6 peptide;
(c) HIV Gag-Pol polyprotein;
(d) MS2 coat protein;
(e) PP7 coat protein;
(f) Qbeta coat protein;
(g) Psi packaging element;
(h) U1A signal recognition particle;
(i) phage R-loop;
(j) Rev protein;
(k) one or more protease cleavage sites;
(l) a protease capable of cleaving the cleavage sites; and
(m) Gag-transframe region-Pol protease polyprotein.

123. The XDP system of any one of embodiments 119-122, wherein the tropism factor is selected from the group consisting of a glycoprotein, an antibody fragment, a receptor, and a ligand to a target cell marker.

124. The XDP system of embodiment 123, wherein the tropism factor is a glycoprotein comprises a sequence selected from the group consisting of the sequences set forth in Table 9 or a sequence encoded by a sequence in Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

125. The XDP system of embodiment 123, wherein the tropism factor is a glycoprotein comprising a sequence selected from the group consisting of the sequences set forth in Table 9 or a sequence encoded by a sequence in Table 65.

126. The XDP system of embodiment 123, wherein the tropism factor is glycoprotein G from vesicular stomatitis virus (VSV-G).

127. The XDP system of embodiment 126, wherein the VSV-G has a sequence selected from the group consisting of the sequences of Table 9.

128. The XDP system of any one of embodiments 119-127, wherein the therapeutic payload comprises a protein, a nucleic acid, or comprises both a protein and a nucleic acid.

129. The XDP system of embodiment 128, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

130. The XDP system of embodiment 129, wherein the CRISPR protein is a Class 1 or Class 2 CRISPR protein.

131. The XDP system of embodiment 130, wherein the CRISPR protein is a Class 2 CRISPR protein selected from the group consisting of Type II, Type V, or Type VI protein.

132. The XDP system of embodiment 131, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12j, Cas12k, Cas14, CasPhi, CasBeta, CasLamda, and CasX.

133. The XDP system of embodiment 132, wherein the CRISPR protein is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

134. The XDP system of embodiment 132, wherein the CRISPR protein is a CasX variant comprising a sequence set forth in Table 3.

135. The XDP system of embodiment 133 or embodiment 134, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

136. The XDP system of embodiment 128, wherein the therapeutic payload is a nucleic acid selected from the group consisting of a single-stranded antisense oligonucleotide (ASOs), a double-stranded RNA interference (RNAi) molecule, a DNA aptamer, an RNA aptamer and a CRISPR guide nucleic acid.

137. The XDP system of any one of embodiments 129-136, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

138. The XDP system of embodiment 136 or embodiment 137, wherein the CRISPR guide nucleic acid is a single-molecule guide RNA comprising a scaffold sequence and a targeting sequence, wherein the targeting sequence is complementary to a target nucleic acid sequence.

139. The XDP system of embodiment 138, wherein the single-molecule guide RNA further comprises one or more components selected from the group consisting of:
i) Stem IIB of Rev response element (RRE),
ii) Stem II-V of RRE;
iii) Stem II of RRE
iv) Rev-binding element (RBE) of Stem IIB; and
v) and full-length RRE
wherein the one or more components are capable of binding Rev.

140. The XDP system of embodiment 138 or embodiment 139, wherein the single-molecule guide RNA further comprises one or more binding partner elements selected from the group consisting of:
  i) MS2 hairpin;
  ii) PP7 hairpin;
  iii) Psi packaging signal;
  iv) Qbeta hairpin; and
  v) U1 hairpin II.

141. The XDP system of any one of embodiments 138-140, wherein the scaffold sequence comprises a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

142. The XDP system of any one of embodiments 138-140, wherein the scaffold sequence of the guide RNA comprises a sequence selected from the group consisting of the sequences set forth in Table 8.

143. The XDP system of any one of embodiments 137-142, wherein the targeting sequence of the guide RNA consists of 14, 15, 16, 17, 18, 19, 20, 21, 22, 23, 24, 25, 26, 27, 28, 29, or 30 consecutive nucleotides.

144. The XDP system of embodiment 143, wherein the targeting sequence has 18, 19 or 20 nucleotides and is complementary to a target nucleic acid sequence.

145. The XDP system of any one of embodiments 117-143, wherein
  (a) the components are encoded on a single nucleic acid;
  (b) the components are encoding on two nucleic acids;
  (c) the components are encoding on three nucleic acids;
  (d) the components are encoding on four nucleic acids; or
  (e) the components are encoding on five nucleic acids.

146. The XDP system of embodiment 145, wherein the one or more of the components encoded by the nucleic acids are configured according to any one of the configurations in Table 11.

147. The XDP system of embodiment 145, wherein the one or more of the components are encoded by nucleic acids selected from the group of sequences set forth in Tables 10, 12, 16, 17, 19, 20, 21, 24, 27, 30, 34, 35, 38, 40, 42, 43, 46, 47, 48, 51, 52, 54, 57, 58, 60, 62, 65, 66, 68, 69, 72, 73, 78, 80, 83, 87, 88, 90, and 104 or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

148. The XDP system of any one of embodiments 119-147, wherein the components are capable of self-assembling into an XDP when the one or more nucleic acids are introduced into a eukaryotic packaging cell and the components are expressed.

149. The XDP of embodiment 148, wherein the therapeutic payload is encapsidated within the XDP upon self-assembly of the XDP in the eukaryotic packaging cell.

150. The XDP system of embodiment 149, wherein the therapeutic payload comprises the CasX variant and the guide RNA complexed as a ribonucleoprotein complex (RNP) and, optionally, a donor template.

151. The XDP system of embodiment 150, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

152. The XDP system of any one of embodiments 140-151, wherein the one or more binding partner elements incorporated into the guide RNA are capable of binding an expressed packaging recruiter incorporated into the Gag polypeptide selected from the group consisting of MS2 coat protein, PP7 coat protein, Qβ coat protein, nucleocapsid, and U1A signal recognition particle, wherein the binding facilitates the incorporation of the RNP into the XDP during self-assembly.

153. The XDP system of embodiment 152, wherein incorporation of the one or more binding partner elements and the packaging recruiter results in at least a 2-fold, at a least 3-fold, at least a 4-fold, at least a 5-fold increase in editing potency of the XDP for the target nucleic acid compared to XDP without the one or more binding partner elements and the packaging recruiter, when assayed in vitro under comparable conditions.

154. The XDP of any one of embodiments 148-151, wherein the tropism factor is incorporated on the XDP surface upon self-assembly of the XDP in the eukaryotic packaging cell.

155. The XDP system of embodiment 153, wherein the tropism factor has binding affinity for a cell surface marker of a target cell and facilitates entry of the XDP into the target cell.

156. The XDP system of embodiment 154 or embodiment 155, wherein incorporation of the glycoprotein results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

157. The XDP system of any one of embodiments 149-156, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

158. An XDP system comprising one or more nucleic acid encoding components:
  (a) all or a portion of an Epsilonretrovirus Gag polyprotein;
  (b) one or more therapeutic payloads; and
  (c) a tropism factor.

159. The XDP system of embodiment 158, wherein the Gag polyprotein comprises one or more components selected from the group consisting of a matrix polypeptide (MA), a p20 peptide, a capsid polypeptide (CA), and a nucleocapsid polypeptide (NC).

160. The XDP system of embodiment 158, wherein the Gag polyprotein comprises, from N-terminus to C-terminus, matrix polypeptide (MA), a p20 peptide, a capsid polypeptide (CA), and a nucleocapsid polypeptide (NC).

161. The XDP system of any one of embodiments 158-160, wherein the nucleic acids encode one or more components selected from
  (a) HIV p1 peptide;
  (b) HIV p6 peptide;
  (c) HIV Gag-Pol polyprotein;

(d) MS2 coat protein;
(e) PP7 coat protein;
(f) Qbeta coat protein;
(g) Psi packaging element;
(h) U1A signal recognition particle;
(i) phage R-loop;
(j) Rev protein;
(k) one or more protease cleavage sites;
(l) a protease capable of cleaving the cleavage sites; and
(m) Gag-transframe region-Pol protease polyprotein.

162. The XDP system of any one of embodiments 158-161, wherein the tropism factor is selected from the group consisting of a glycoprotein, an antibody fragment, a receptor, and a ligand to a target cell marker.

163. The XDP system of embodiment 162, wherein the tropism factor is a glycoprotein comprises a sequence selected from the group consisting of the sequences set forth in Table 9 or is encoded by a sequence of Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

164. The XDP system of embodiment 162, wherein the tropism factor is a glycoprotein comprising a sequence selected from the group consisting of the sequences set forth in Table 9 or is encoded by a sequence of Table 65.

165. The XDP system of embodiment 162 wherein the tropism factor is glycoprotein G from vesicular stomatitis virus (VSV-G).

166. The XDP system of embodiment 165, wherein the VSV-G has a sequence selected from the group consisting of the sequences of Table 9.

167. The XDP system of any one of embodiments 158-166, wherein the therapeutic payload comprises a protein, a nucleic acid, or comprises both a protein and a nucleic acid.

168. The XDP system of embodiment 167, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

169. The XDP system of embodiment 168, wherein the CRISPR protein is a Class 1 or Class 2 CRISPR protein.

170. The XDP system of embodiment 169, wherein the CRISPR protein is a Class 2 CRISPR protein selected from the group consisting of Type II, Type V, or Type VI protein.

171. The XDP system of embodiment 170, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12j, Cas12k, Cas14, CasPhi, CasBeta, CasLamda, and CasX.

172. The XDP system of embodiment 171, wherein the CRISPR protein is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

173. The XDP system of embodiment 171, wherein the CRISPR protein is a CasX variant comprising a sequence set forth in Table 3.

174. The XDP system of any one of embodiments 171-173, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

175. The XDP system of embodiment 167, wherein the therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

176. The XDP system of any one of embodiments 168-174, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

177. The XDP system of embodiment 176, wherein the CRISPR guide nucleic acid is a single-molecule guide RNA comprising a scaffold sequence and a targeting sequence, wherein the targeting sequence is complementary to a target nucleic acid sequence.

178. The XDP system of embodiment 177, wherein the single-molecule guide RNA further comprises one or more components selected from the group consisting of:
i) Stem IIB of Rev response element (RRE),
ii) Stem II-V of RRE;
iii) Stem II of RRE
iv) Rev-binding element (RBE) of Stem IIB; and
v) and full-length RRE
wherein the one or more components are capable of binding Rev.

179. The XDP system of embodiment 177 or embodiment 178, wherein the single-molecule guide RNA further comprises one or more binding partner elements selected from the group consisting of:
i) MS2 hairpin;
ii) PP7 hairpin;
iii) Psi packaging signal;
iv) Qbeta hairpin; and
v) U1 hairpin II.

180. The XDP system of any one of embodiments 177-179, wherein the scaffold sequence comprises a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

181. The XDP system of any one of embodiments 177-179, wherein the scaffold sequence of the guide RNA comprises a sequence selected from the group consisting of the sequences set forth in Table 8.

182. The XDP system of any one of embodiments 177-181, wherein the targeting sequence of the guide RNA consists of 14, 15, 16, 17, 18, 19, 20, 21, 22, 23, 24, 25, 26, 27, 28, 29, or 30 consecutive nucleotides.

183. The XDP system of embodiment 182, wherein the targeting sequence has 18, 19 or 20 nucleotides and is complementary to a target nucleic acid sequence.

184. The XDP system of any one of embodiments 156-182, wherein
(a) the components are encoded on a single nucleic acid;
(b) the components are encoding on two nucleic acids;
(c) the components are encoding on three nucleic acids;
(d) the components are encoding on four nucleic acids; or
(e) the components are encoding on five nucleic acids.

185. The XDP system of embodiment 184, wherein the one or more of the components encoded by the nucleic acids are configured according to any one of configurations in Table 11.

186. The XDP system of embodiment 184 or embodiment 185, wherein the one or more of the components are encoded by nucleic acids selected from the group of sequences consisting of SEQ ID NOS: 192, 193, 195, 196, 198-201, 782, 234-339, 880-933, and 947-1000, or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

187. The XDP system of any one of embodiments 158-186, wherein the components are capable of self-assembling into an XDP when the one or more nucleic acids are introduced into a eukaryotic packaging cell and the components are expressed.

188. The XDP of embodiment 187, wherein the therapeutic payload is encapsidated within the XDP upon self-assembly of the XDP in the eukaryotic packaging cell.

189. The XDP system of embodiment 188, wherein the therapeutic payload comprises the CasX variant and the guide RNA complexed as a ribonucleoprotein complex (RNP) and, optionally, a donor template.

190. The XDP system of embodiment 189, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

191. The XDP system of any one of embodiments 179-190, wherein the one or more binding partner elements incorporated into the guide RNA are capable of binding an expressed packaging recruiter incorporated into the Gag polyprotein selected from the group consisting of MS2 coat protein, PP7 coat protein, Qbeta coat protein, nucleocapsid, and U1A signal recognition particle, wherein the binding facilitates the incorporation of the RNP into the XDP during self-assembly.

192. The XDP system of embodiment 191, wherein incorporation of the one or more binding partner elements and the packaging recruiter results in at least a 2-fold, at a least 3-fold, at least a 4-fold, at least a 5-fold increase in editing potency of the XDP for the target nucleic acid compared to XDP without the one or more binding partner elements and the packaging recruiter, when assayed in vitro under comparable conditions.

193. The XDP of any one of embodiments 188, wherein the tropism factor is incorporated on the XDP surface upon self-assembly of the XDP in the eukaryotic packaging cell.

194. The XDP system of embodiment 190, wherein the tropism factor has binding affinity for a cell surface marker of a target cell and facilitates entry of the XDP into the target cell.

195. The XDP system of embodiment 193 or embodiment 194, wherein incorporation of the glycoprotein results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

196. The XDP system of any one of embodiments 189-195, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

197. An XDP system comprising one or more nucleic acid encoding components:
(a) all or a portion of an Gammaretrovirus Gag polyprotein;
(b) one or more therapeutic payloads; and
(c) a tropism factor.

198. The XDP system of embodiment 197, wherein the Gag polyprotein comprises one or more components selected from the group consisting of a matrix polypeptide (MA), a p12 peptide, a capsid polypeptide (CA), and a nucleocapsid polypeptide (NC).

199. The XDP system of embodiment 198, wherein the Gag polyprotein comprises, from N-terminus to C-terminus, matrix polypeptide (MA), a p12 peptide, a capsid polypeptide (CA), and a nucleocapsid polypeptide (NC).

200. The XDP system of any one of embodiments 197-199, wherein the nucleic acids encode one or more components selected from
(a) HIV p1 peptide;
(b) HIV p6 peptide;
(c) HIV Gag-Pol polyprotein;
(d) MS2 coat protein;
(e) PP7 coat protein;
(f) Qbeta coat protein;
(g) Psi packaging element;
(h) U1A signal recognition particle;
(i) phage R-loop;
(j) Rev protein;
(k) one or more protease cleavage sites;
(l) a protease capable of cleaving the cleavage sites; and
(m) Gag-transframe region-Pol protease polyprotein.

201. The XDP system of any one of embodiments 197-200, wherein the tropism factor is selected from the group consisting of a glycoprotein, an antibody fragment, a receptor, and a ligand to a target cell marker.

202. The XDP system of embodiment 201, wherein the tropism factor is a glycoprotein comprises a sequence selected from the group consisting of the sequences set forth in Table 9 and or is encoded by a sequence of Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

203. The XDP system of embodiment 201, wherein the tropism factor is a glycoprotein comprises a sequence selected from the group consisting of the sequences set forth in Table 9 or is encoded by a sequence of Table 65.

204. The XDP system of embodiment 201, wherein the tropism factor is glycoprotein G from vesicular stomatitis virus (VSV-G).

205. The XDP system of embodiment 204, wherein the VSV-G has a sequence selected from the group consisting of the sequences of Table 9.

206. The XDP system of any one of embodiments 197-205, wherein the therapeutic payload comprises a protein, a nucleic acid, or comprises both a protein and a nucleic acid.

207. The XDP system of embodiment 206, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

208. The XDP system of embodiment 207, wherein the CRISPR protein is a Class 1 or Class 2 CRISPR protein.

209. The XDP system of embodiment 208, wherein the CRISPR protein is a Class 2 CRISPR protein selected from the group consisting of Type II, Type V, or Type VI protein.

210. The XDP system of embodiment 209, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12j, Cas12k, Cas14, CasPhi, CasBeta, CasLamda, and CasX.

211. The XDP system of embodiment 210, wherein the CRISPR protein is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

212. The XDP system of embodiment 210, wherein the CRISPR protein is a CasX variant comprising a sequence set forth in Table 3.

213. The XDP system of embodiment 211 or embodiment 212, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

214. The XDP system of embodiment 206, wherein the therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

215. The XDP system of any one of embodiments 207-213, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

216. The XDP system of embodiment 214 or embodiment 215, wherein the CRISPR guide nucleic acid is a single-molecule guide RNA comprising a scaffold sequence and a targeting sequence, wherein the targeting sequence is complementary to a target nucleic acid sequence.

217. The XDP system of embodiment 216, wherein the single-molecule guide RNA further comprises one or more components selected from the group consisting of:
  i) Stem IIB of Rev response element (RRE),
  ii) Stem II-V of RRE;
  iii) Stem II of RRE
  iv) Rev-binding element (RBE) of Stem IIB; and
  v) and full-length RRE
  wherein the one or more components are capable of binding Rev.

218. The XDP system of embodiment 216 or embodiment 217, wherein the single-molecule guide RNA further comprises one or more binding partner elements selected from the group consisting of:
  i) MS2 hairpin;
  ii) PP7 hairpin;
  iii) Psi packaging signal;
  iv) Qbeta hairpin; and
  v) U1 hairpin II.

219. The XDP system of any one of embodiments 216-218, wherein the scaffold sequence comprises a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

220. The XDP system of any one of embodiments 215, wherein the scaffold sequence comprises a sequence selected from the group consisting of the sequences set forth in Table 8.

221. The XDP system of any one of embodiments 215-220, wherein the targeting sequence of the guide RNA consists of 14, 15, 16, 17, 18, 19, 20, 21, 22, 23, 24, 25, 26, 27, 28, 29, or 30 consecutive nucleotides.

222. The XDP system of embodiment 221, wherein the targeting sequence has 18, 19 or 20 nucleotides and is complementary to a target nucleic acid sequence.

223. The XDP system of any one of embodiments 197-222, wherein
  (a) the components are encoded on a single nucleic acid;
  (b) the components are encoding on two nucleic acids;
  (c) the components are encoding on three nucleic acids;
  (d) the components are encoding on four nucleic acids; or
  (e) the components are encoding on five nucleic acids.

224. The XDP system of embodiment 223, wherein the one or more of the components encoded by the nucleic acids are configured according to any one of configurations in Table 11.

225. The XDP system of embodiment 223 or embodiment 224, wherein the one or more of the components are encoded by nucleic acids selected from the group of sequences consisting of the sequences set forth in Tables 10, 12, 16, 17, 19, 20, 21, 24, 27, 30, 34, 35, 38, 40, 42, 43, 46, 47, 48, 51, 52, 54, 57, 58, 60, 62, 65, 66, 68, 69, 72, 73, 78, 80, 83, 87, 88, 90, and 104, or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

226. The XDP system of any one of embodiments 223-225, wherein the components are capable of self-assembling into an XDP when the one or more nucleic acids are introduced into a eukaryotic packaging cell and the components are expressed.

227. The XDP of embodiment 226, wherein the therapeutic payload is encapsidated within the XDP upon self-assembly of the XDP in the eukaryotic packaging cell.

228. The XDP system of embodiment 227, wherein the therapeutic payload comprises the CasX variant and the guide RNA complexed as a ribonucleoprotein complex (RNP) and, optionally, a donor template.

229. The XDP system of embodiment 228, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

230. The XDP system of any one of embodiments 218-229, wherein the one or more binding partner elements incorporated into the guide RNA are capable of binding an expressed packaging recruiter incorporated into the Gag polyprotein selected from the group consisting of MS2 coat protein, PP7 coat protein, Qbeta coat protein, nucleocapsid, and U1A signal recognition particle, wherein the binding facilitates the incorporation of the RNP into the XDP during self-assembly.

231. The XDP system of embodiment 230, wherein incorporation of the one or more binding partner elements and the packaging recruiter results in at least a 2-fold, at a least 3-fold, at least a 4-fold, at least a 5-fold increase in editing potency of the XDP for the target nucleic acid compared to XDP without the one or more binding partner elements and the packaging recruiter, when assayed in vitro under comparable conditions.

232. The XDP of any one of embodiments 226-231, wherein the tropism factor is incorporated on the XDP surface upon self-assembly of the XDP in the eukaryotic packaging cell.

233. The XDP system of embodiment 232, wherein the tropism has binding affinity for a cell surface marker of a target cell and facilitates entry of the XDP into the target cell.

234. The XDP system of embodiment 232 or embodiment 233, wherein incorporation of the glycoprotein results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

235. An XDP system comprising one or more nucleic acids encoding one or more components selected from:
(a) all or a portion of a Lentivirus Gag polyprotein;
(b) one or more therapeutic payloads; and
(c) a tropism factor.

236. The XDP system of embodiment 235, wherein the Gag polyprotein comprises one or more components selected from the group consisting of a matrix polypeptide (MA), a capsid polypeptide (CA), a p2 peptide, a nucleocapsid polypeptide (NC), a p1 peptide, and a p6 peptide.

237. The XDP system of embodiment 236, wherein the Gag polyprotein comprises, from N-terminus to C-terminus, matrix polypeptide (MA), a capsid polypeptide (CA), a p2 peptide, a nucleocapsid polypeptide (NC), a p1 peptide, and a p6 peptide.

238. The XDP system of any one of embodiments 235-237, wherein the nucleic acids encode one or more components selected from
(a) HIV Gag-Pol polyprotein;
(b) MS2 coat protein;
(c) PP7 coat protein;
(d) Qbeta coat protein;
(e) Psi packaging element;
(f) U1A signal recognition particle;
(g) phage R-loop;
(h) Rev protein;
(i) one or more protease cleavage sites;
(j) a protease capable of cleaving the cleavage sites; and
(k) Gag-transframe region-Pol protease polyprotein.

239. The XDP system of any one of embodiments 235-238, wherein the lentivirus is selected from the group consisting of human immunodeficiency-1 (HIV-1), human immunodeficiency-2 (HIV-2), simian immunodeficiency virus (SIV), feline immunodeficiency virus (FIV), and bovine immunodeficiency virus (BIV).

240. The XDP system of embodiment 239, wherein the lentivirus is HIV-1

241. The XDP system of any one of embodiments 235-240, wherein the tropism factor is selected from the group consisting of a glycoprotein, an antibody fragment, a receptor, and a ligand to a target cell marker.

242. The XDP system of embodiment 241, wherein the tropism factor is a glycoprotein comprising a sequence selected from the group consisting of the sequences set forth in Table 9 or encoded by a sequence of Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

243. The XDP system of embodiment 241, wherein the tropism factor is a glycoprotein comprising a sequence selected from the group consisting of the sequences set forth in Table 9 or encoded by a sequence of Table 65.

244. The XDP system of embodiment 243, wherein the tropism factor is glycoprotein G from vesicular stomatitis virus (VSV-G).

245. The XDP system of embodiment 244, wherein the VSV-G has a sequence selected from the group consisting of the sequences of Table 9.

246. The XDP system of any one of embodiments 235-245, wherein the therapeutic payload comprises a protein, a nucleic acid, or comprises both a protein and a nucleic acid.

247. The XDP system of embodiment 246, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

248. The XDP system of embodiment 247, wherein the CRISPR protein is a Class 1 or Class 2 CRISPR protein.

249. The XDP system of embodiment 248, wherein the CRISPR protein is a Class 2 CRISPR protein selected from the group consisting of Type II, Type V, or Type VI protein.

250. The XDP system of embodiment 249, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12j, Cas12k, Cas14, CasPhi, CasBeta, CasLamda, and CasX.

251. The XDP system of embodiment 250, wherein the CRISPR protein is a CasX variant comprising a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

252. The XDP system of embodiment 250, wherein the CRISPR protein is a CasX variant comprising a sequence selected from the group consisting of the sequences set forth in Table 8.

253. The XDP system of embodiment 251 or embodiment 252, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

254. The XDP system of embodiment 246, wherein therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

255. The XDP system of any one of embodiments 246-253, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

256. The XDP system of embodiment 255, wherein the CRISPR guide nucleic acid is a single-molecule guide RNA comprising a scaffold sequence and a targeting sequence, wherein the targeting sequence is complementary to a target nucleic acid sequence.

257. The XDP system of embodiment 256, wherein the single-molecule guide RNA further comprises one or more components selected from the group consisting of:
  i) Stem IIB of Rev response element (RRE);
  ii) Stem II-V of RRE;
  iii) Stem II of RRE
  iv) Rev-binding element (RBE) of Stem IIB; and
  v) and full-length RRE,
  wherein the one or more components are capable of binding Rev.

258. The XDP system of embodiment 256 or embodiment 257, wherein the single-molecule guide RNA further comprises one or more binding partner elements selected from the group consisting of:
  i) MS2 hairpin;
  ii) PP7 hairpin;
  iii) Psi packaging signal;
  iv) Qbeta hairpin; and
  v) U1 hairpin II.

259. The XDP system of any one of embodiments 256-258, wherein the scaffold sequence comprises a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

260. The XDP system of any one of embodiments 256-258, wherein the scaffold sequence of the guide RNA comprises a sequence selected from the group consisting of the sequences set forth in Table 8.

261. The XDP system of any one of embodiments 256-260, wherein the targeting sequence of the guide RNA consists of 14, 15, 16, 17, 18, 19, 20, 21, 22, 23, 24, 25, 26, 27, 28, 29, or 30 consecutive nucleotides.

262. The XDP system of embodiment 261, wherein the targeting sequence has 18, 19 or 20 nucleotides and is complementary to a target nucleic acid sequence.

263. The XDP system of any one of embodiments 235-262, wherein
  (a) the components are encoded on a single nucleic acid;
  (b) the components are encoding on two nucleic acids;
  (c) the components are encoding on three nucleic acids;
  (d) the components are encoding on four nucleic acids; or
  (e) the components are encoding on five nucleic acids.

264. The XDP system of embodiment 263, wherein the one or more of the components encoded by the nucleic acids are configured according to any one of FIG. 16, 45-54, 67, 68, 83, 90-92, 118, 137, or 173.

265. The XDP system of embodiment 263 or embodiment 264, wherein the one or more of the components are encoded by nucleic acids selected from the group of sequences consisting of the group consisting of the sequences set forth in Tables 10, 12, 16, 17, 19, 20, 21, 24, 27, 30, 34, 35, 38, 40, 42, 43, 46, 47, 48, 51, 52, 54, 57, 58, 60, 62, 65, 66, 68, 69, 72, 73, 78, 80, 83, 87, 88, 90 and 104, or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

266. The XDP system of any one of embodiments 263-265, wherein the components are capable of self-assembling into an XDP when the one or more nucleic acids are introduced into a eukaryotic packaging cell and the components are expressed.

267. The XDP of embodiment 266, wherein the therapeutic payload is encapsidated within the XDP upon self-assembly of the XDP in the eukaryotic packaging cell.

268. The XDP system of embodiment 267, wherein the therapeutic payload comprises a CasX variant and a guide RNA complexed as a ribonucleoprotein complex (RNP) and, optionally, a donor template.

269. The XDP system of embodiment 268, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

270. The XDP system of any one of embodiments 258-269, wherein the one or more binding partner elements incorporated into the guide RNA are capable of binding an expressed packaging recruiter selected from the group consisting of MS2 coat protein, PP7 coat protein, Q☐ coat protein, nucleocapsid, and U1A signal recognition particle, wherein the binding facilitates the incorporation of the RNP into the XDP during self-assembly.

271. The XDP of any one of embodiments 266-270, wherein the tropism factor is incorporated on the XDP surface upon self-assembly of the XDP in the eukaryotic packaging cell.

272. The XDP system of embodiment 271, wherein the tropism factor has binding affinity for a cell surface marker of a target cell and facilitates entry of the XDP into the target cell.

273. The XDP system of embodiment 271 or embodiment 272, wherein incorporation of the glycoprotein results in at least a 2-fold, at least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

274. The XDP system of any one of embodiments 268-273, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

275. An XDP system comprising one or more nucleic acid encoding components:
   (a) all or a portion of an Spumaretrovirinae Gag polyprotein;
   (b) one or more therapeutic payloads; and
   (c) a tropism factor.

276. The XDP system of embodiment 275, wherein the Gag polyprotein comprises one or more components selected from the group consisting of a p68 Gag polypeptide and a p3 Gag polypeptide.

277. The XDP system of embodiment 276, wherein the Gag polyprotein comprises, from N-terminus to C-terminus, p68 Gag polypeptide and a p3 Gag polypeptide.

278. The XDP system of any one of embodiments 275-277, wherein the nucleic acids encode one or more components selected from
   (a) HIV p 1 peptide;
   (b) HIV p6 peptide;
   (c) HIV Gag-Pol polyprotein;
   (d) MS2 coat protein;
   (e) PP7 coat protein;
   (f) Qbeta coat protein;
   (g) Psi packaging element;
   (h) U1A signal recognition particle;
   (i) phage R-loop;
   (j) Rev protein;
   (k) one or more protease cleavage sites;
   (l) a protease capable of cleaving the cleavage sites; and
   (m) Gag-transframe region-Pol protease polyprotein.

279. The XDP system of any one of embodiments 275-278, wherein the tropism factor is selected from the group consisting of a glycoprotein, an antibody fragment, a receptor, and a ligand to a target cell marker.

280. The XDP system of embodiment 279, wherein the tropism factor is a glycoprotein comprising a sequence selected from the group consisting of the sequences set forth in Table 9 or encoded by a sequence of Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

281. The XDP system of embodiment 279, wherein the tropism factor is a glycoprotein comprising a sequence selected from the group consisting of the sequences set forth in Table 9 and or encoded by a sequence of Table 65.

282. The XDP system of embodiment 281, wherein the tropism factor is glycoprotein G from vesicular stomatitis virus (VSV-G).

283. The XDP system of embodiment 282, wherein the VSV-G has a sequence selected from the group consisting of the sequences of Table 9.

284. The XDP system of any one of embodiments 275-283, wherein the therapeutic payload comprises a protein, a nucleic acid, or comprises both a protein and a nucleic acid.

285. The XDP system of embodiment 284, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

286. The XDP system of embodiment 285, wherein the CRISPR protein is a Class 1 or Class 2 CRISPR protein.

287. The XDP system of embodiment 286, wherein the CRISPR protein is a Class 2 CRISPR protein selected from the group consisting of Type II, Type V, or Type VI protein.

288. The XDP system of embodiment 287, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12j, Cas12k, Cas14, CasPhi, CasBeta, CasLamda, and CasX.

289. The XDP system of embodiment 288, wherein the CRISPR protein is a CasX variant comprising a sequence selected from the group consisting of the sequences set forth in Table 4, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

290. The XDP system of embodiment 289, wherein the CRISPR protein is a CasX variant comprising a sequence selected from the group consisting of the sequences set forth in Table 4.

291. The XDP system of embodiment 289 or embodiment 290, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

292. The XDP system of embodiment 284, wherein the therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

293. The XDP system of any one of embodiments 285-292, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

294. The XDP system of embodiment 292 or embodiment 293, wherein the CRISPR guide nucleic acid is a single-molecule guide RNA comprising a scaffold sequence and a targeting sequence, wherein the targeting sequence is complementary to a target nucleic acid sequence.

295. The XDP system of embodiment 293, wherein the single-molecule guide RNA further comprises one or more components selected from the group consisting of:
i) Stem IIB of Rev response element (RRE),
ii) Stem II-V of RRE;
iii) Stem II of RRE
iv) Rev-binding element (RBE) of Stem IIB; and
v) and full-length RRE,
wherein the one or more components are capable of binding Rev.

296. The XDP system of embodiment 294 or embodiment 295, wherein the single-molecule guide RNA further comprises one or more binding partner elements selected from the group consisting of:
i) MS2 hairpin;
ii) PP7 hairpin;
iii) Psi packaging signal;
iv) Qbeta hairpin; and
v) U1 hairpin II.

297. The XDP system of any one of embodiments 294-296, wherein the scaffold sequence comprises a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

298. The XDP system of any one of embodiments 294-296, wherein the scaffold sequence of the guide RNA comprises a sequence selected from the group consisting of the sequences set forth in Table 8.

299. The XDP system of any one of embodiments 294-298, wherein the targeting sequence of the guide RNA consists of 14, 15, 16, 17, 18, 19, 20, 21, 22, 23, 24, 25, 26, 27, 28, 29, or 30 consecutive nucleotides.

300. The XDP system of embodiment 299, wherein the targeting sequence has 18, 19 or 20 nucleotides and is complementary to a target nucleic acid sequence.

301. The XDP system of any one of embodiments 275-300, wherein
(a) the components are encoded on a single nucleic acid;
(b) the components are encoding on two nucleic acids;
(c) the components are encoding on three nucleic acids;
(d) the components are encoding on four nucleic acids; or
(e) the components are encoding on five nucleic acids.

302. The XDP system of embodiment 301, wherein the one or more of the components encoded by the nucleic acids are configured according to any one of FIG. 16, 45-54, 67, 68, 83, 90-92, 118, or 137.

303. The XDP system of embodiment 301 or embodiment 302, wherein the one or more of the components are encoded by nucleic acids selected from the group of sequences consisting of selected from the sequences set forth in Tables 10, 12, 16, 17, 19, 20, 21, 24, 27, 30, 34, 35, 38, 40, 42, 43, 46, 47, 48, 51, 52, 54, 57, 58, 60, 62, 65, 66, 68, 69, 72, 73, 78, 80, 83, 87, 88, 90, and 104, or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

304. The XDP system of any one of embodiments 301-303, wherein the components are capable of self-assembling into an XDP when the one or more nucleic acids are introduced into a eukaryotic packaging cell and the components are expressed.

305. The XDP of embodiment 304, wherein the therapeutic payload is encapsidated within the XDP upon self-assembly of the XDP in the eukaryotic packaging cell.

306. The XDP system of embodiment 305, wherein the therapeutic payload comprises the CasX variant and the guide RNA complexed as a ribonucleoprotein complex (RNP) and, optionally, a donor template.

307. The XDP system of embodiment 306, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

308. The XDP system of any one of embodiments 296-307, wherein the one or more binding partner elements incorporated into the guide RNA are capable of binding an expressed packaging recruiter selected from the group consisting of MS2 coat protein, PP7 coat protein, Qβ coat protein, nucleocapsid, and U1A signal recognition particle, wherein the binding facilitates the incorporation of the RNP into the XDP during self-assembly.

309. The XDP of any one of embodiments 304-308, wherein the tropism factor is incorporated on the XDP surface upon self-assembly of the XDP in the eukaryotic packaging cell.

310. The XDP system of embodiment 307, wherein the tropism factor has binding affinity for a cell surface marker of a target cell and facilitates entry of the XDP into the target cell.

311. The XDP system of embodiment 309 or embodiment 310, wherein incorporation of the glycoprotein results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

312. The XDP system of any one of embodiments 306-311, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

313. The XDP system of any one of the preceding embodiments, wherein the Gag polyprotein and the therapeutic payload is expressed as a fusion protein.

314. The XDP system of embodiment 313, wherein the fusion protein does not comprise a protease cleavage site between the Gag polyprotein and the therapeutic payload.

315. The XDP system of embodiment 313, wherein the fusion protein comprises a protease cleavage site between the Gag polyprotein and the therapeutic payload.

316. The XDP system of any one of embodiments 313-315, wherein the fusion protein comprises protease cleavage sites between the components of the Gag polyprotein.

317. The XDP system of embodiment 315 or embodiment 316, wherein the cleavage sites are capable of being cleaved by the protease of the Gag-Pol polyprotein, the protease of the Gag-transframe region-Pol protease polyprotein, or a non-retroviral, heterologous protease.

318. The XDP system of embodiment 317, wherein the cleavage sites are capable of being cleaved by the protease of the Gag-transframe region-Pol protease polyprotein.

319. The XDP system of embodiment 317, wherein the cleavage sites are capable of being cleaved by the protease of the Gag-Pol polyprotein 320. The XDP system of embodiment 317, wherein the non-retroviral, heterologous protease is selected from the group consisting of tobacco etch virus protease (TEV), potyvirus HC protease, potyvirus P1 protease, PreScission (HRV3C protease), b virus NIa protease, B virus RNA-2-encoded protease, aphthovirus L protease, enterovirus 2A protease, rhinovirus 2A protease, picorna 3C protease, comovirus 24K protease, nepovirus 24K protease, RTSV (rice tungro spherical virus) 3C-like protease, parsnip yellow fleck virus protease, 3C-like protease, heparin, cathepsin, thrombin, factor Xa, metalloproteinase, and enterokinase.

321. The XDP system of embodiment 320, wherein the non-retroviral, heterologous protease is PreScission (HRV3C protease).

322. The XDP system of embodiment 320, wherein the non-retroviral, heterologous protease is tobacco etch virus protease (TEV).

323. A eukaryotic cell comprising the XDP system of any one of the preceding embodiments.

324. The eukaryotic cell of embodiment 323, wherein the cell is a packaging cell.

325. The eukaryotic cell of embodiment 323 or embodiment 324, wherein the eukaryotic cell is selected from the group consisting of HEK293 cells, HEK293T cells, Lenti-X 293T cells, BHK cells, HepG2, Saos-2, HuH7, NS0 cells, SP2/0 cells, YO myeloma cells, A549 cells, P3X63 mouse myeloma cells, PER cells, PER.C6 cells, hybridoma cells, VERO, NIH3T3 cells, COS, WI38, MRCS, A549, HeLa cells, CHO cells, and HT1080 cells.

326. The eukaryotic cell of embodiment 324 or embodiment 325, wherein the packaging cell is modified to reduce expression of a cell surface marker.

327. The eukaryotic cell of embodiment 326, wherein the cell surface marker is selected from the group consisting of B2M, CD47 and HLA-E KI, wherein the incorporation of the cell surface marker on the surface of the XDP released from the packaging cell is reduced compared to XDP released from a packaging cell that has not be modified.

328. The eukaryotic cell of any one of embodiments 324-327, wherein the packaging cell is modified to express one or more cell surface markers selected from CD46, CD47, CD55, and CD59, wherein the incorporation of the cell surface marker on the surface of the XDP released from the packaging cell is increased compared to XDP released from a packaging cell that has not be modified.

329. A method of making an XDP comprising a therapeutic payload, the method comprising:
(a) propagating the packaging cell of any one of embodiments 324-328 under conditions such that XDPs are produced; and
(b) harvesting the XDPs produced by the packaging cell.

330. The method of embodiment 329, wherein the packaging cell is HEK293T.

331. The method of embodiment 329 or embodiment 330, wherein expression of the incorporated binding partner element(s) and packaging recruiter(s) results in at least a 2-fold, at least 3-fold, or at least a 4-fold increase in editing potency of the XDP compared to XDP without the incorporated binding partner element(s) and packaging recruiter (s), when assayed in vitro under comparable conditions.

332. An XDP produced by the method of any one of embodiments 329-331.

333. The XDP of embodiment 332, comprising a therapeutic payload of one or more RNPs of the CasX variant and the guide RNA and, optionally, a donor template.

334. A method of modifying a target nucleic acid sequence in a population of cells, the method comprising contacting the cells with the XDP of embodiment 332 or embodiment 333, wherein said contacting comprises introducing the into the cell the RNP and, optionally, the donor template nucleic acid sequence, wherein the target nucleic acid targeted by the guide RNA is modified by the CasX variant.

335. The method of embodiment 334, wherein the RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

336. The method of embodiment 334 or embodiment 335, wherein the modification comprises introducing one or more single-stranded breaks in the target nucleic acid sequence.

337. The method of embodiment 334 or embodiment 335, wherein the modification comprises introducing one or more double-stranded breaks in the target nucleic acid sequence.

338. The method of any one of embodiments 334-337, wherein the modification comprises introducing an insertion, deletion, substitution, duplication, or inversion of one or more nucleotides in the target nucleic acid sequence of the cells.

339. The method of any one of embodiments 334-338, wherein the modification comprises insertion of the donor template into the target nucleic acid sequence of the cells.

340. The method of any one of embodiments 334-339, wherein the cells are modified in vitro or ex vivo.

341. The method of any one of embodiments 334-339, wherein the cells are modified in vivo.

342. The method of embodiment 341, wherein the XDP is administered to a subject.

343. The method of embodiment 342, wherein the subject is the subject is selected from the group consisting of mouse, rat, pig, non-human primate, and human.

344. The method of embodiment 342 or embodiment 343, wherein the XDP is administered by a route of administration selected from the group consisting of subcutaneous, intradermal, intraneural, intranodal, intramedullary, intramuscular, intravenous, intracerebroventricular, intracisternal, intrathecal, intracranial, intralumbar, intratracheal, intraosseous, inhalatory, intracontralateral striatum, intraocular, intravitreal, intralymphatical, intraperitoneal and sub-retinal routes.

345. The method of any one of embodiments 342-344, wherein the XDP is administered to the subject using a therapeutically effective dose.

346. The method of embodiment 345, wherein the XDP is administered at a dose of at least about $1 \times 10^5$ particles/kg, or at least about $1 \times 10^6$ particles/kg, or at least about $1 \times 10^7$ particles/kg, or at least about $1 \times 10^8$ particles/kg, or at least about $1 \times 10^9$ particles/kg, or at least about $1 \times 10^{10}$ particles/kg, or at least about $1 \times 10^{11}$ particles/kg, or at least about $1 \times 10^{12}$ particles/kg, or at least about $1 \times 10^{13}$ particles/kg, or at least about $1 \times 10^{14}$ particles/kg, or at least about $1 \times 10^{15}$ particles/kg, or at least about $1 \times 10^{16}$ particles/kg.

347. The method of any one of embodiments 342-346, wherein the XDP is administered to the subject according to a treatment regimen comprising one or more consecutive doses using a therapeutically effective dose of the XDP.

348. The method of embodiment 347, wherein the therapeutically effective dose is administered to the subject as two or more doses over a period of at least two weeks, or at least one month, or at least two months, or at least three months, or at least four months, or at least five months, or at least six months, or once a year, or every 2 or 3 years.

349. A method for introducing a CasX variant and gNA RNP into a cell having a target nucleic acid, comprising contacting the cell with the XDP of embodiments 332 or embodiment 333, such that the RNP enters the cell.

350. The method of embodiment 349, wherein the RNP binds to the target nucleic acid.

351. The method of embodiment 350, wherein the target nucleic acid is cleaved by the CasX variant.

352. The method of any one of embodiments 349-351, wherein the cell is modified in vitro.

353. The method of any one of embodiments 349-351, wherein the cell is modified in vivo.

354. The method of embodiment 353, wherein the XDP is administered to a subject.

355. The method of embodiment 354, wherein the subject is the subject is selected from the group consisting of mouse, rat, pig, non-human primate, and human.

356. The method of any one of embodiments 353-355, wherein the XDP is administered to the subject using a therapeutically effective dose.

357. The method of embodiment 356, wherein the XDP is administered at a dose of at least about $1 \times 10^5$ particles/kg, or at least about $1 \times 10^6$ particles/kg, or at least about $1 \times 10^7$ particles/kg, or at least about $1 \times 10^8$ particles/kg, or at least about $1 \times 10^9$ particles/kg, or at least about $1 \times 10^{10}$ particles/kg, or at least about $1 \times 10^{11}$ particles/kg, or at least about $1 \times 10^{12}$ particles/kg, or at least about $1 \times 10^{13}$ particles/kg, or at least about $1 \times 10^{14}$ particles/kg, or at least about $1 \times 10^{15}$ particles/kg, or at least about $1 \times 10^{16}$ particles/kg.

358. A XDP particle comprising:
(a) a retroviral matrix (MA) polypeptide;
(b) a therapeutic payload encapsidated within the XDP; and
(c) a tropism factor incorporated on the XDP surface.

359. The XDP particle of embodiment 358, further comprising one or more retroviral components selected from:
(a) a capsid polypeptide (CA);
(b) a nucleocapsid polypeptide (NC);
(c) a P2A peptide, a P2B peptide;
(d) a P10 peptide;
(e) a p12 peptide
(f) a PP21/24 peptide;
(g) a P12/P3/P8 peptide;
(h) a P20 peptide;
(i) a p1 peptide; and
(j) a p6 peptide 360. The XDP particle of embodiment 358 or embodiment 359, wherein the tropism factor is selected from the group consisting of a glycoprotein, an antibody fragment, a receptor, and a ligand to a target cell marker.

361. The XDP particle of embodiment 360, wherein the tropism factor is a glycoprotein comprising a sequence selected from the group consisting of the sequences set forth in Table 9 or is encoded by a sequence of Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

362. The XDP particle of embodiment 360, wherein the tropism factor is a glycoprotein comprising an encoding sequence selected from the group consisting of the sequences set forth in Table 9 or is encoded by a sequence of Table 65.

363. The XDP particle of any one of embodiments 358-362, wherein the therapeutic payload comprises a protein, a nucleic acid, or comprises both a protein and a nucleic acid.

364. The XDP particle of embodiment 363, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

365. The XDP particle of embodiment 364, wherein the CRISPR protein is a Class 1 or Class 2 CRISPR protein.

366. The XDP particle of embodiment 365, wherein the CRISPR protein is a Class 2 CRISPR protein selected from the group consisting of Type II, Type V, or Type VI protein.

367. The XDP particle of embodiment 366, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12j, Cas12k, Cas14, CasPhi, CasBeta, CasLamda, and CasX.

368. The XDP particle of embodiment 367, wherein the CRISPR protein is a CasX variant comprising a sequence selected from the group consisting of the sequences set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

369. The XDP particle of embodiment 367, wherein the CRISPR protein is a CasX variant comprising a sequence selected from the group consisting of the sequences set forth in Table 3.

370. The XDP particle of embodiment 363, wherein the therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

371. The XDP system of any one of embodiments 357-368, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

372. The XDP particle of embodiment 369, wherein the CRISPR guide nucleic acid is a single-molecule guide RNA comprising a scaffold sequence and a targeting sequence, wherein the targeting sequence comprises between 14 and 30 nucleotides and is complementary to a target nucleic acid sequence.

373. The XDP system of embodiment 372, wherein the single-molecule guide RNA further comprises one or more components selected from the group consisting of:
  i) Stem IIB of Rev response element (RRE),
  ii) Stem II-V of RRE;
  iii) Stem II of RRE
  iv) Rev-binding element (RBE) of Stem IIB; and
  v) and full-length RRE.

374. The XDP system of embodiment 372 or embodiment 373, wherein the single-molecule guide RNA further comprises one or more binding partner elements selected from the group consisting of:
  i) MS2 hairpin;
  ii) PP7 hairpin;
  iii) Psi packaging signal;
  iv) Qbeta hairpin; and
  v) U1 hairpin II.

375. The XDP particle of any one of embodiments 372-374, wherein the scaffold sequence comprises a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

376. The XDP particle of any one of embodiments 372-374, wherein the scaffold sequence comprises a sequence selected from the group consisting of the sequences set forth in Table 8.

377. The XDP particle of any one of embodiments 367-376, wherein the therapeutic payload comprises the CasX variant and the guide RNA complexed as a ribonucleoprotein complex (RNP) and, optionally, a donor template.

378. The XDP particle of embodiment 377, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

379. The XDP system of embodiment 377 or embodiment 378, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

380. The XDP particle of any one of embodiments 358-379, wherein the retroviral components are derived from a Orthoretrovirinae virus or a Spumaretrovirinae virus.

381. The XDP particle of embodiment 380, wherein the Orthoretrovirinae virus is selected from the group consisting of Alpharetrovirus, Betaretrovirus, Deltaretrovirus, Epsilonretrovirus, Gammaretrovirus, and Lentivirus.

382. The XDP particle of embodiment 381, wherein the Spumaretrovirinae virus is selected from the group consisting of Bovispumavirus, Equispumavirus, Felispumavirus, Prosimiispumavirus, Simiispumavirus, and Spumavirus.

383. The XDP particles, or the XDP systems of any one of the preceding embodiments, for use as a medicament for the treatment of a subject having a disease.

Set 2.

1. A delivery particle (XDP) system comprising one or more nucleic acids encoding components of:
  (a) one or more retroviral components;
  (b) one or more therapeutic payloads; and
  (c) a tropism factor.

2. The XDP system of embodiment 1, wherein the therapeutic payload comprises a protein, a nucleic acid, or comprises both a protein and a nucleic acid.

3. The XDP system of embodiment 1 or 2, wherein the therapeutic payload comprises a nucleic acid selected from the group consisting of a single-stranded antisense oligonucleotide (ASOs), a double-stranded RNA interference (RNAi) molecule, a DNA aptamer, an RNA aptamer, a CRISPR guide nucleic acid, a donor template, or any combination thereof.

4. The XDP system of embodiment 2 or embodiment 3, wherein the CRISPR guide nucleic acid is a single-molecule guide RNA (gRNA) variant comprising a scaffold sequence and a targeting sequence, wherein the targeting sequence comprises between 14 and 30 nucleotides and is complementary to a target nucleic acid sequence.

5. The XDP system of embodiment 4, wherein the targeting sequence has 18, 19 or 20 nucleotides and is complementary to a target nucleic acid sequence.

6. The XDP system of embodiment 4 or embodiment 5, wherein the scaffold of the gRNA variant further comprises one or more binding partner elements selected from the group consisting of:
  i) Stem IIB of Rev response element (RRE),
  ii) Stem II-V of RRE;
  iii) Stem II of RRE
  iv) Rev-binding element (RBE) of Stem IIB; and
  v) and full-length RRE,
  wherein the one or more components are capable of binding Rev.

7. The XDP system of any one of embodiments 4-6, wherein the scaffold of the gRNA variant further comprises one or more binding partner elements selected from the group consisting of:
  i) MS2 hairpin;
  ii) PP7 hairpin;

iii) Qbeta hairpin;
iv) Psi packaging signal;
v) U1 hairpin II; and
vi) Psi RNA packaging signal.

8. The XDP system of any one of embodiments 4-7, wherein the gRNA scaffold sequence comprises a sequence selected from the group consisting of the sequences as set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

9. The XDP system of any one of embodiments 4-7, wherein the gRNA scaffold sequence comprises a sequence selected from the group consisting of the sequences as set forth in Table 8.

10. The XDP system of any one of the preceding embodiments, wherein the tropism factor is selected from the group consisting of a glycoprotein, an antibody fragment, a receptor, and a ligand to a target cell marker.

11. The XDP system of embodiment 10, wherein the tropism factor is a glycoprotein having sequence selected from the group consisting of the sequences set forth in Table 9, or is encoded by a sequence set forth in Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

12. The XDP system of embodiment 10, wherein the tropism factor is a glycoprotein having a sequence selected from the group consisting of the sequences set forth in Table 9, or is encoded by a sequence set forth in Table 65.

13. The XDP system of embodiment 2, wherein the protein payload is selected from the group consisting of a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

14. The XDP system of embodiment 13, wherein the CRISPR protein is a Class 1 or Class 2 CRISPR protein.

15. The XDP system of embodiment 14, wherein the CRISPR protein is a Class 2 CRISPR protein selected from the group consisting of a Type II, a Type V, or a Type VI protein.

16. The XDP system of embodiment 15, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12k, Cas14, CasPhi, CasBeta, and CasX.

17. The XDP system of embodiment 16, wherein the CRISPR protein is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

18. The XDP system of embodiment 16, wherein the CRISPR protein is a CasX variant comprising a sequence set forth in Table 3.

19. The XDP system of any one of embodiments 3-13, further comprising a protein payload wherein the protein payload is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

20. The XDP system of any one of embodiments 3-13, further comprising a protein payload wherein the protein payload is a CasX variant comprising a sequence set forth in Table 3.

21. The XDP system of any one of embodiments 17-20, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of SR, RS, (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

22. The XDP system of any one of embodiments 17-20, wherein the CasX variant further comprises one or more NLS selected from the group of sequences consisting of the sequences of Table 5, wherein the one or more NLS are located at or near the N-terminus and/or the C-terminus of the CasX variant.

23. The XDP system of any one of the preceding embodiments, wherein the nucleic acids further encode one or more components selected from:
   (a) all or a portion of a retroviral Gag polyprotein;
   (b) MS2 coat protein;
   (c) PP7 coat protein;
   (d) Qbeta coat protein;
   (e) U1A signal recognition particle;
   (f) phage R-loop;
   (g) Rev protein;
   (h) Psi packaging element;
   (i) one or more protease cleavage sites;
   (j) Gag-transframe region-Pol protease polyprotein (Gag-TFR-PR);
   (k) a retroviral Gag-Pol polyprotein; and
   (l) a protease capable of cleaving the one or more protease cleavage sites.

24. The XDP system of any one of the preceding embodiments, wherein one or more of the retroviral components are derived from an Orthoretrovirinae virus or a Spumaretrovirinae virus.

25. The XDP system of embodiment 24, wherein the Orthoretrovirinae virus is selected from the group consisting of an Alpharetrovirus, Betaretrovirus, Deltaretrovirus, Epsilonretrovirus, Gammaretrovirus, and Lentivirus.

26. The XDP system of embodiment 24, wherein the Spumaretrovirinae virus is selected from the group consisting of Bovispumavirus, Equispumavirus, Felispumavirus, Prosimiispumavirus, Simiispumavirus, or Spumavirus.

27. The XDP system of any one of the preceding embodiments, wherein
   (a) the components are encoded on a single nucleic acid;
   (b) the components are encoded on two nucleic acids;
   (c) the components are encoded on three nucleic acids;
   (d) the components are encoded on four nucleic acids; or
   (e) the components are encoded on five nucleic acids.

28. The XDP system of embodiment 27, wherein the one or more of the components encoded by the nucleic acids are configured according to any one of the configurations in Table 11.

29. The XDP system of embodiment 27 or embodiment 28, wherein the one or more of the retroviral components are encoded by a nucleic acid selected from the group of sequences consisting of the sequences set forth in Table 10.

30. The XDP system of any one of the preceding embodiments, wherein the components are capable of self-assembling into an XDP when the one or more nucleic acids are introduced into a eukaryotic packaging cell and the components are expressed.

31. The XDP of embodiment 30, wherein the therapeutic payloads are encapsidated within the XDP upon self-assembly of the XDP in the eukaryotic packaging cell.

32. The XDP system of embodiment 31, wherein the therapeutic payload comprises the CasX variant and the gRNA variant complexed as a ribonucleoprotein complex (RNP) and, optionally, a donor template.

33. The XDP system of embodiment 32, wherein an RNP of the CasX variant and the gRNA variant exhibits at least a 2-fold improvement in cleavage velocity of a target nucleic acid compared to an RNP of a reference CasX and a reference guide RNA, when assayed in vitro under comparable conditions.

34. The XDP system of any one of embodiments 4-33, wherein the one or more binding partner elements incorporated into the scaffold of the gRNA variant are capable of binding an expressed packaging recruiter incorporated into the Gag polyprotein selected from the group consisting of MS2 coat protein, PP7 coat protein, Qbeta coat protein, nucleocapsid protein, and U1A signal recognition particle, wherein the binding facilitates the incorporation of the RNP into the XDP during self-assembly in a packaging cell.

35. The XDP system of embodiment 34, wherein incorporation of the one or more binding partner elements and the packaging recruiter in the XDP results in at least a 2-fold, at a least 3-fold, at least a 4-fold, at least a 5-fold increase in editing potency of the XDP for a target nucleic acid compared to XDP without the one or more binding partner elements and the packaging recruiter, when assayed in vitro under comparable conditions.

36. The XDP system of embodiment 34 or embodiment 35, wherein the scaffold of the gRNA variant comprises an MS2 hairpin variant sequence wherein the gRNA variant exhibits enhanced binding affinity to the MS2 coat protein in an in vitro assay.

37. The XDP system of embodiment 36, wherein the gRNA variant is selected from the group consisting of gRNA variants 188, 251, and 296-325.

38. The XDP system of embodiment 36 or embodiment 37, wherein the MS2 variant hairpin sequence is selected from the group consisting of ACAUGAGGAUCACCCAUGU (SEQ ID NO: 1846), ACCUGAGGAUCACCCAGGU (SEQ ID NO: 1847), GCAUGAGGAUCACCCAUGC (SEQ ID NO: 1848), GCCUGAGGAUCACCCAGGC (SEQ ID NO: 1849), GCCUGAGCAUCAGCCAGGC (SEQ ID NO: 1850), ACAUGAGCAUCAGCCAUGU (SEQ ID NO: 1851), ACUUGAGGAUCACCCAUGU (SEQ ID NO: 1852), ACAUUAGGAUCACCAAUGU (SEQ ID NO: 1853), and ACAUGAGGACCACCCAUGU (SEQ ID NO: 1854).

39. The XDP system of any one of embodiments 36-38, wherein the gRNA variant exhibits a $K_D$ to the MS2 coat protein of less than 100 nM, less than 50 nM, less than 35 nM, less than 10 nM, less than 3 nM, or less than 2 nM in an in vitro assay.

40. The XDP system of embodiment 39, wherein the XDP exhibits improved editing activity towards a target nucleic acid in an in vitro cellular assay compared to an XDP where in the gRNA does not incorporate an MDS hairpin variant.

41. The XDP system of embodiment 40, wherein the improved editing activity results in an EC50 of less than 108, or less than 107, or less than 106 particles to achieve editing in 50% of the cells in the in vitro assay.

42. The XDP of any one of embodiments 35-41, wherein the gRNA MS2 variant exhibits a $K_D$ to its ligand of less than 10 nM and wherein the XDP exhibits editing activity towards a target nucleic acid in an in vitro cellular assay wherein the EC50 is less than 107 or 106 particles.

43. The XDP of any one of embodiments 30-42, wherein the tropism factor is incorporated on the XDP surface upon self-assembly of the XDP in the eukaryotic packaging cell.

44. The XDP system of embodiment 43, wherein the tropism factor has binding affinity for a cell surface marker of a target cell and facilitates entry of the XDP into the target cell.

45. The XDP system of embodiment 43 or embodiment 44, wherein incorporation of the tropism factor results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

46. The XDP system of any one of embodiments 32-45, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

47. An XDP system comprising one or more nucleic acids encoding components:
   (a) all or a portion of an Alpharetrovirus Gag polyprotein;
   (b) one or more therapeutic payloads; and
   (c) a tropism factor.

48. The XDP system of embodiment 47, wherein the Gag polyprotein comprises one or more components selected from the group consisting of a matrix polypeptide (MA), a P2A peptide, a P2B peptide, a P10 peptide, a capsid polypeptide (CA), and a nucleocapsid polypeptide (NC).

49. The XDP system of embodiment 48, wherein the Gag polyprotein comprises, from N-terminus to C-terminus, a matrix polypeptide (MA), a P2A peptide, a P2B peptide, a P10 peptide, a capsid polypeptide (CA), and a nucleocapsid polypeptide (NC).

50. The XDP system of any one of embodiments 47-49, wherein the one or more nucleic acids further encode one or more components selected from (a) HIV p1 peptide;
(b) HIV p6 peptide;
(c) HIV Gag-Pol polyprotein;
(d) MS2 coat protein;
(e) PP7 coat protein;
(f) Qbeta coat protein;
(g) Psi packaging element;
(h) U1A signal recognition particle;
(i) phage R-loop;
(j) Rev protein;
(k) one or more protease cleavage sites;
(l) a protease capable of cleaving the cleavage sites; and
(m) Gag-transframe region-Pol protease polyprotein.

51. The XDP system of any one of embodiments 47-50, wherein the tropism factor is selected from the group consisting of a glycoprotein, an antibody fragment, a receptor, and a ligand to a target cell marker.

52. The XDP system of embodiment 51, wherein the tropism factor is a glycoprotein having sequence selected from the group consisting the sequences set forth in Table 9, and or is encoded by a sequence set forth in Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

53. The XDP system of embodiment 51, wherein the tropism factor is a glycoprotein having sequence selected from the group of sequences consisting of the sequences set forth in Table 9, or is encoded by a sequence set forth in Table 65.

54. The XDP system of embodiment 51, wherein the tropism factor is glycoprotein G from vesicular stomatitis virus (VSV-G).

55. The XDP system of embodiment 54, wherein the VSV-G has a sequence selected from the group consisting of the sequences of Table 9.

56. The XDP system of any one of embodiments 47-55, wherein the therapeutic payload comprises a protein, a nucleic acid, or comprises both a protein and a nucleic acid.

57. The XDP system of embodiment 56, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

58. The XDP system of embodiment 57, wherein the CRISPR protein is a Class 1 or Class 2 CRISPR protein.

59. The XDP system of embodiment 58, wherein the CRISPR protein is a Class 2 CRISPR protein selected from the group consisting of Type II, Type V, or Type VI protein.

60. The XDP system of embodiment 59, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12k, Cas14, CasPhi, CasBeta, and CasX.

61. The XDP system of embodiment 60, wherein the CRISPR protein is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

62. The XDP system of embodiment 60, wherein the CRISPR protein is a CasX variant comprising a sequence set forth in Table 3.

63. The XDP system of embodiment 61 or embodiment 62, wherein the CasX variant further comprises one or more NLS selected from the group of sequences consisting of SEQ ID NOS: 35-83 and 1858 wherein the NLS are located at or near the N-terminus and/or the C-terminus and, optionally, the one or more NLS are linked to the CasX variant or to adjacent NLS with a linker peptide wherein the linker peptide is selected from the group consisting of SR, RS, (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

64. The XDP system of embodiment 61 or embodiment 62, wherein the CasX variant further comprises one or more NLS selected from the group of sequences consisting of the sequences of Table 5, wherein the one or more NLS are located at or near the N-terminus and/or the C-terminus of the CasX variant.

65. The XDP system any one of embodiments 47-55, wherein the therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

66. The XDP system of any one of embodiments 57-64, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

67. The XDP system of embodiment 66, wherein the CRISPR guide nucleic acid is a single-molecule guide RNA comprising a scaffold sequence and a targeting sequence, wherein the targeting sequence is complementary to a target nucleic acid sequence.

68. The XDP system of embodiment 66, wherein the single-molecule guide RNA further comprises one or more components selected from the group consisting of:
  i) Stem IIB of Rev response element (RRE),
  ii) Stem II-V of RRE;
  iii) Stem II of RRE
  iv) Rev-binding element (RBE) of Stem IIB; and
  v) and full-length RRE,
wherein the one or more components are capable of binding Rev.

69. The XDP system of embodiment 67 or embodiment 68, wherein the single-molecule guide RNA further comprises one or more binding partner elements selected from the group consisting of:
  i) MS2 hairpin;
  ii) PP7 hairpin;
  iii) Qbeta hairpin; and
  iv) U1 hairpin II.

70. The XDP system of any one of embodiments 66-69, wherein the scaffold sequence comprises a sequence set forth in Table 4 or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

71. The XDP system of any one of embodiments 66-69, wherein the scaffold sequence of the guide RNA comprises a sequence set forth in Table 4.

72. The XDP system of any one of embodiments 66-71, wherein the targeting sequence of the guide RNA consists of 14, 15, 16, 17, 18, 19, 20, 21, 22, 23, 24, 25, 26, 27, 28, 29, or 30 consecutive nucleotides.

73. The XDP system of embodiment 72, wherein the targeting sequence has 18, 19 or 20 nucleotides and is complementary to a target nucleic acid sequence.

74. The XDP system of any one of embodiments 47-73, wherein
(a) the components are encoded on a single nucleic acid;
(b) the components are encoding on two nucleic acids;
(c) the components are encoding on three nucleic acids;
(d) the components are encoding on four nucleic acids; or
(e) the components are encoding on five nucleic acids.

75. The XDP system of embodiment 73, wherein the one or more of the components encoded by the nucleic acids are configured according to any one of the configurations in Table 11.

76. The XDP system of embodiment 74 or embodiment 75, wherein the one or more of the components are encoded by nucleic acids selected from the group of sequences set forth in Tables 10, 12, 16, 17, 19, 20, 21, 24, 27, 30, 34, 35, 38, 40, 42, 43, 46, 47, 48, 51, 52, 54, 57, 58, 60, 62, 65, 66, 68, 69, 72, 73, 78, 80, 83, 87, 88, 90 and 104, or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

77. The XDP system of any one of embodiments 47-76, wherein the components are capable of self-assembling into an XDP when the one or more nucleic acids are introduced into a eukaryotic packaging cell and the components are expressed.

78. The XDP of embodiment 77, wherein the therapeutic payload is encapsidated within the XDP upon self-assembly of the XDP in the eukaryotic packaging cell.

79. The XDP system of embodiment 78, wherein the therapeutic payload comprises the CasX variant and the guide RNA complexed as a ribonucleoprotein complex (RNP) and, optionally, a donor template.

80. The XDP system of embodiment 79, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

81. The XDP system of any one of embodiments 69-80, wherein the one or more binding partner elements incorporated into the guide RNA are capable of binding an expressed packaging recruiter incorporated into the Gag polypeptide selected from the group consisting of MS2 coat protein, PP7 coat protein, Qbeta coat protein, nucleocapsid protein, and U1A signal recognition particle, wherein the binding facilitates the incorporation of the RNP into the XDP during self-assembly.

82. The XDP system of embodiment 81, wherein incorporation of the one or more binding partner elements and the packaging recruiter results in at least a 2-fold, at least 3-fold, at least a 4-fold, at least a 5-fold increase in editing potency of the XDP for the target nucleic acid compared to XDP without the one or more binding partner elements and the packaging recruiter, when assayed in vitro under comparable conditions.

83. The XDP of any one of embodiments 77-80, wherein the tropism factor is incorporated on the XDP surface upon self-assembly of the XDP in the eukaryotic packaging cell.

84. The XDP system of embodiment 80, wherein the tropism factor has binding affinity for a cell surface marker of a target cell and facilitates entry of the XDP into the target cell.

85. The XDP system of embodiment 83 or embodiment 84, wherein incorporation of the glycoprotein results in at least a 2-fold, at least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

86. The XDP system of any one of embodiments 79-85, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

87. An XDP system comprising one or more nucleic acids encoding components:
(a) all or a portion of an Betaretrovirus Gag polyprotein;
(b) one or more therapeutic payloads; and
(c) a tropism factor.

88. The XDP system of embodiment 87, wherein the Gag polyprotein comprises one or more components selected from the group consisting of a matrix polypeptide (MA), a PP21/24 peptide, a P12/P3/P8 peptide, a capsid polypeptide (CA), and a nucleocapsid polypeptide (NC).

89. The XDP system of embodiment 88, wherein the Gag polyprotein comprises components, from N-terminus to C-terminus, a matrix polypeptide (MA), a PP21/24 peptide, a P12/P3/P8 peptide, a capsid polypeptide (CA), and a nucleocapsid polypeptide (NC) and, optionally, a protease cleavage site between components.

90. The XDP system of any one of embodiments 87-89, wherein the nucleic acids further encode one or more components selected from
(a) HIV p1 peptide;
(b) HIV p6 peptide;
(c) HIV Gag-Pol polyprotein;
(d) MS2 coat protein;
(e) PP7 coat protein;
(f) Qbeta coat protein;
(g) Psi packaging element;
(h) U1A signal recognition particle;
(i) phage R-loop;
(j) Rev protein;
(k) one or more protease cleavage sites;
(l) a protease capable of cleaving the cleavage sites; and
(m) Gag-transframe region-Pol protease polyprotein.

91. The XDP system of any one of embodiments 87-90, wherein the tropism factor is selected from the group consisting of a glycoprotein, an antibody fragment, a receptor, and a ligand to a target cell marker.

92. The XDP system of embodiment 91, wherein the tropism factor is a glycoprotein comprising a sequence selected from the group consisting of the sequences set forth in Table 9 and Table 65, or encoded by a sequence of Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

93. The XDP system of embodiment 91, wherein the tropism factor is a glycoprotein comprising a sequence selected from the group consisting of the sequences set forth in Table 9, and or encoded by a sequence of Table 65.

94. The XDP system of embodiment 93, wherein the tropism factor is glycoprotein G from vesicular stomatitis virus (VSV-G).

95. The XDP system of embodiment 92, wherein the VSV-G has a sequence selected from the group consisting of the sequences of Table 9.

96. The XDP system of any one of embodiments 85-95, wherein the therapeutic payload comprises a protein, a nucleic acid, or comprises both a protein and a nucleic acid.

97. The XDP system of embodiment 96, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

98. The XDP system of embodiment 97, wherein the CRISPR protein is a Class 1 or Class 2 CRISPR protein.

99. The XDP system of embodiment 98, wherein the CRISPR protein is a Class 2 CRISPR protein selected from the group consisting of Type II, Type V, or Type VI protein.

100. The XDP system of embodiment 99, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12k, Cas14, CasPhi, CasBeta, and CasX.

101. The XDP system of embodiment 100, wherein the CRISPR protein is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

102. The XDP system of embodiment 100, wherein the CRISPR protein is a CasX variant comprising a sequence set forth in Table 3.

103. The XDP system of embodiment 101 or embodiment 102, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of SR, RS, (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

104. The XDP system any one of embodiments 87-95, wherein the therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

105. The XDP system of any one of embodiments 97-104, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

106. The XDP system of embodiment 104, wherein the CRISPR guide nucleic acid is a single-molecule guide RNA comprising a scaffold sequence and a targeting sequence, wherein the targeting sequence is complementary to a target nucleic acid sequence.

107. The XDP system of embodiment 105, wherein the single-molecule guide RNA further comprises one or more components selected from the group consisting of:
  i) Stem IIB of Rev response element (RRE),
  ii) Stem II-V of RRE;
  iii) Stem II of RRE
  iv) Rev-binding element (RBE) of Stem IIB; and
  v) and full-length RRE,
  herein the one or more components are capable of binding Rev.

108. The XDP system of embodiment 106 or embodiment 107, wherein the single-molecule guide RNA further comprises one or more binding partner elements selected from the group consisting of:
  i) MS2 hairpin;
  ii) PP7 hairpin;
  iii) Psi packaging signal;
  iv) Qbeta hairpin; and
  v) U1 hairpin II.

109. The XDP system of any one of embodiments 105, wherein the scaffold sequence comprises a sequence selected from the group consisting of the sequences set forth in Table 4, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

110. The XDP system of any one of embodiments 105-108, wherein the scaffold sequence of the guide RNA comprises a sequence selected from the group consisting of the sequences set forth in Table 4.

111. The XDP system of any one of embodiments 105-110, wherein the targeting sequence of the guide RNA consists of 14, 15, 16, 17, 18, 19, 20, 21, 22, 23, 24, 25, 26, 27, 28, 29, or 30 consecutive nucleotides.

112. The XDP system of embodiment 111, wherein the targeting sequence has 18, 19 or 20 nucleotides and is complementary to a target nucleic acid sequence.

113. The XDP system of any one of embodiments 87-112, wherein
  (a) the components are encoded on a single nucleic acid;
  (b) the components are encoding on two nucleic acids;
  (c) the components are encoding on three nucleic acids;

(d) the components are encoding on four nucleic acids; or (e) the components are encoding on five nucleic acids.

114. The XDP system of embodiment 113, wherein the one or more of the components encoded by the nucleic acids are configured according to any one of the configurations in Table 11.

115. The XDP system of embodiment 113 or embodiment 114, wherein the one or more of the components are encoded by nucleic acids selected from the group of sequences consisting of the sequences set forth in Tables 10, 12, 16, 17, 19, 20, 21, 24, 27, 30, 34, 35, 38, 40, 42, 43, 46, 47, 48, 51, 52, 54, 57, 58, 60, 62, 65, 66, 68, 69, 72, 73, 78, 80, 83, 87, 88, 90 and 104 or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

116. The XDP system of any one of embodiments 8785-115, wherein the components are capable of self-assembling into an XDP when the one or more nucleic acids are introduced into a eukaryotic packaging cell and the components are expressed.

117. The XDP of embodiment 116, wherein the therapeutic payload is encapsidated within the XDP upon self-assembly of the XDP in the eukaryotic packaging cell.

118. The XDP system of embodiment 117, wherein the therapeutic payload comprises the CasX variant and the guide RNA complexed as a ribonucleoprotein complex (RNP) and, optionally, a donor template.

119. The XDP system of embodiment 118, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

120. The XDP system of any one of embodiments 108-119, wherein the one or more binding partner elements incorporated into the guide RNA are capable of binding an expressed packaging recruiter incorporated into the Gag polypeptide selected from the group consisting of MS2 coat protein, PP7 coat protein, Qbeta coat protein, nucleocasid, and U1A signal recognition particle, wherein the binding facilitates the incorporation of the RNP into the XDP during self-assembly.

121. The XDP system of embodiment 120, wherein incorporation of the one or more binding partner elements and the packaging recruiter results in at least a 2-fold, at a least 3-fold, at least a 4-fold, at least a 5-fold increase in editing potency of the XDP for the target nucleic acid compared to XDP without the one or more binding partner elements and the packaging recruiter, when assayed in vitro under comparable conditions.

122. The XDP of any one of embodiments 116, wherein the tropism factor is incorporated on the XDP surface upon self-assembly of the XDP in the eukaryotic packaging cell.

123. The XDP system of embodiment 119, wherein the tropism factor has binding affinity for a cell surface marker of a target cell and facilitates entry of the XDP into the target cell.

124. The XDP system of embodiment 122 or embodiment 123, wherein incorporation of the glycoprotein results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

125. The XDP system of any one of embodiments 118-124, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

126. An XDP system comprising one or more nucleic acid encoding components:

(a) all or a portion of an Deltaretrovirus Gag polyprotein;

(b) one or more therapeutic payloads; and (c) a tropism factor.

127. The XDP system of embodiment 126, wherein the Gag polyprotein comprises one or more components selected from the group consisting of a matrix polypeptide (MA), a capsid polypeptide (CA), and a nucleocapsid polypeptide (NC).

128. The XDP system of embodiment 127, wherein the Gag polyprotein comprises, from N-terminus to C-terminus, matrix polypeptide (MA), a capsid polypeptide (CA), and a nucleocapsid polypeptide (NC).

129. The XDP system of any one of embodiments 126-128, wherein the nucleic acids encode one or more components selected from (a) HIV p1 peptide;

(b) HIV p6 peptide;

(c) HIV Gag-Pol polyprotein;

(d) MS2 coat protein;

(e) PP7 coat protein;

(f) Qbeta coat protein;

(g) Psi packaging element;

(h) U1A signal recognition particle;

(i) phage R-loop;

(j) Rev protein;

(k) one or more protease cleavage sites;

(l) a protease capable of cleaving the cleavage sites; and (m) Gag-transframe region-Pol protease polyprotein.

130. The XDP system of any one of embodiments 126-129, wherein the tropism factor is selected from the group consisting of a glycoprotein, an antibody fragment, a receptor, and a ligand to a target cell marker.

131. The XDP system of embodiment 130, wherein the tropism factor is a glycoprotein comprises a sequence selected from the group consisting of the sequences set forth in Table 9, or a sequence encoded by a sequence in Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

132. The XDP system of embodiment 130, wherein the tropism factor is a glycoprotein comprising a sequence selected from the group consisting of the sequences set forth in Table 9, or a sequence encoded by a sequence in Table 65.

133. The XDP system of embodiment 130, wherein the tropism factor is glycoprotein G from vesicular stomatitis virus (VSV-G).

134. The XDP system of embodiment 133, wherein the VSV-G has a sequence selected from the group consisting of the sequences of Table 9.

135. The XDP system of any one of embodiments 126, wherein the therapeutic payload comprises a protein, a nucleic acid, or comprises both a protein and a nucleic acid.

136. The XDP system of embodiment 135, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

137. The XDP system of embodiment 136, wherein the CRISPR protein is a Class 1 or Class 2 CRISPR protein.

138. The XDP system of embodiment 137, wherein the CRISPR protein is a Class 2 CRISPR protein selected from the group consisting of Type II, Type V, or Type VI protein.

139. The XDP system of embodiment 138, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12k, Cas14, CasPhi, CasBeta, and CasX.

140. The XDP system of embodiment 139, wherein the CRISPR protein is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

141. The XDP system of embodiment 139, wherein the CRISPR protein is a CasX variant comprising a sequence set forth in Table 3.

142. The XDP system of embodiment 140 or embodiment 141, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of SR, RS, (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

143. The XDP system of embodiment 135, wherein the therapeutic payload is a nucleic acid selected from the group consisting of a single-stranded antisense oligonucleotide (ASOs), a double-stranded RNA interference (RNAi) molecule, a DNA aptamer, an RNA aptamer and a CRISPR guide nucleic acid.

144. The XDP system of any one of embodiments 136-143, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

145. The XDP system of embodiment 143 or embodiment 144, wherein the CRISPR guide nucleic acid is a single-molecule guide RNA comprising a scaffold sequence and a targeting sequence, wherein the targeting sequence is complementary to a target nucleic acid sequence.

146. The XDP system of embodiment 144, wherein the single-molecule guide RNA further comprises one or more components selected from the group consisting of:
i) Stem IIB of Rev response element (RRE);
ii) Stem II-V of RRE;
iii) Stem II of RRE
iv) Rev-binding element (RBE) of Stem IIB; and
v) and full-length RRE
herein the one or more components are capable of binding Rev.

147. The XDP system of embodiment 145 or embodiment 146, wherein the single-molecule guide RNA further comprises one or more binding partner elements selected from the group consisting of:
i) MS2 hairpin;
ii) PP7 hairpin;
iii) Psi packaging signal;
iv) Qbeta hairpin; and
v) U1 hairpin II.

148. The XDP system of embodiment 144, wherein the scaffold sequence comprises a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

149. The XDP system of any one of embodiments 145-147, wherein the scaffold sequence of the guide RNA comprises a sequence selected from the group consisting of the sequences set forth in Table 8.

150. The XDP system of any one of embodiments 144-149, wherein the targeting sequence of the guide RNA consists of 14, 15, 16, 17, 18, 19, 20, 21, 22, 23, 24, 25, 26, 27, 28, 29, or 30 consecutive nucleotides.

151. The XDP system of embodiment 150, wherein the targeting sequence has 18, 19 or 20 nucleotides and is complementary to a target nucleic acid sequence.

152. The XDP system of any one of embodiments 124-151, wherein
(a) the components are encoded on a single nucleic acid;
(b) the components are encoding on two nucleic acids;
(c) the components are encoding on three nucleic acids;
(d) the components are encoding on four nucleic acids; or
(e) the components are encoding on five nucleic acids.

153. The XDP system of embodiment 152 wherein the one or more of the components encoded by the nucleic acids are configured according to any one of the configurations in Table 11.

154. The XDP system of embodiment 152, wherein the one or more of the components are encoded by nucleic acids selected from the group of sequences set forth in Tables 10, 12, 16, 17, 19, 20, 21, 24, 27, 30, 34, 35, 38, 40, 42, 43, 46, 47, 48, 51, 52, 54, 57, 58, 60, 62, 65, 66, 68, 69, 72, 73, 78, 80, 83, 87, 88, 90 and 104, or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

155. The XDP system of any one of embodiments 124-154, wherein the components are capable of self-assembling into an XDP when the one or more nucleic acids are introduced into a eukaryotic packaging cell and the components are expressed.

156. The XDP of embodiment 155, wherein the therapeutic payload is encapsidated within the XDP upon self-assembly of the XDP in the eukaryotic packaging cell.

157. The XDP system of embodiment 156, wherein the therapeutic payload comprises the CasX variant and the guide RNA complexed as a ribonucleoprotein complex (RNP) and, optionally, a donor template.

158. The XDP system of embodiment 157, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

159. The XDP system of any one of embodiments 147-158, wherein the one or more binding partner elements incorporated into the guide RNA are capable of binding an expressed packaging recruiter incorporated into the Gag polypeptide selected from the group consisting of MS2 coat protein, PP7 coat protein, Qbeta coat protein, nucleocapsid, and U1A signal recognition particle, wherein the binding facilitates the incorporation of the RNP into the XDP during self-assembly.

160. The XDP system of embodiment 159, wherein incorporation of the one or more binding partner elements and the packaging recruiter results in at least a 2-fold, at least 3-fold, at least a 4-fold, at least a 5-fold increase in editing potency of the XDP for the target nucleic acid compared to XDP without the one or more binding partner elements and the packaging recruiter, when assayed in vitro under comparable conditions.

161. The XDP of any one of embodiments 155-158, wherein the tropism factor is incorporated on the XDP surface upon self-assembly of the XDP in the eukaryotic packaging cell.

162. The XDP system of embodiment 160, wherein the tropism factor has binding affinity for a cell surface marker of a target cell and facilitates entry of the XDP into the target cell.

163. The XDP system of embodiment 161 or embodiment 162, wherein incorporation of the glycoprotein results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

164. The XDP system of any one of embodiments 156-163, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

165. An XDP system comprising one or more nucleic acid encoding components:
  (a) all or a portion of an Epsilonretrovirus Gag polyprotein;
  (b) one or more therapeutic payloads; and
  (c) a tropism factor.

166. The XDP system of embodiment 165, wherein the Gag polyprotein comprises one or more components selected from the group consisting of a matrix polypeptide (MA), a p20 peptide, a capsid polypeptide (CA), and a nucleocapsid polypeptide (NC).

167. The XDP system of embodiment 163, wherein the Gag polyprotein comprises, from N-terminus to C-terminus, matrix polypeptide (MA), a p20 peptide, a capsid polypeptide (CA), and a nucleocapsid polypeptide (NC).

168. The XDP system of any one of embodiments 165-167, wherein the nucleic acids encode one or more components selected from
  (a) HIV p1 peptide;
  (b) HIV p6 peptide;
  (c) HIV Gag-Pol polyprotein;
  (d) MS2 coat protein;
  (e) PP7 coat protein;
  (f) Qbeta coat protein;
  (g) Psi packaging element;
  (h) U1A signal recognition particle;
  (i) phage R-loop;
  (j) Rev protein;
  (k) one or more protease cleavage sites;
  (l) a protease capable of cleaving the cleavage sites; and
  (m) Gag-transframe region-Pol protease polyprotein.

169. The XDP system of any one of embodiments 165-168, wherein the tropism factor is selected from the group consisting of a glycoprotein, an antibody fragment, a receptor, and a ligand to a target cell marker.

170. The XDP system of embodiment 169, wherein the tropism factor is a glycoprotein comprises a sequence selected from the group consisting of the sequences set forth in Table 9, or is encoded by a sequence of Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

171. The XDP system of embodiment 169, wherein the tropism factor is a glycoprotein comprising a sequence selected from the group consisting of the sequences set forth in Table 9, or is encoded by a sequence of Table 65.

172. The XDP system of embodiment 171, wherein the tropism factor is glycoprotein G from vesicular stomatitis virus (VSV-G).

173. The XDP system of embodiment 172, wherein the VSV-G has a sequence selected from the group consisting of the sequences of Table 9.

174. The XDP system of any one of embodiments 165-173, wherein the therapeutic payload comprises a protein, a nucleic acid, or comprises both a protein and a nucleic acid.

175. The XDP system of embodiment 173, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

176. The XDP system of embodiment 175, wherein the CRISPR protein is a Class 1 or Class 2 CRISPR protein.

177. The XDP system of embodiment 176, wherein the CRISPR protein is a Class 2 CRISPR protein selected from the group consisting of Type II, Type V, or Type VI protein.

178. The XDP system of embodiment 177, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12k, Cas14, CasPhi, CasBeta, and CasX.

179. The XDP system of embodiment 178, wherein the CRISPR protein is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

180. The XDP system of embodiment 178, wherein the CRISPR protein is a CasX variant comprising a sequence set forth in Table 3.

181. The XDP system of any one of embodiments 178-180, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of SR, RS, (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

182. The XDP system of embodiment 174, wherein the therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

183. The XDP system of any one of embodiments 175-181, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

184. The XDP system of embodiment 183, wherein the CRISPR guide nucleic acid is a single-molecule guide RNA comprising a scaffold sequence and a targeting sequence, wherein the targeting sequence is complementary to a target nucleic acid sequence.

185. The XDP system of embodiment 184, wherein the single-molecule guide RNA further comprises one or more components selected from the group consisting of:
  i) Stem IIB of Rev response element (RRE),
  ii) Stem II-V of RRE;
  iii) Stem II of RRE
  iv) Rev-binding element (RBE) of Stem IIB; and
  v) and full-length RRE
wherein the one or more components are capable of binding Rev.

186. The XDP system of embodiment 184 or embodiment 185, wherein the single-molecule guide RNA further comprises one or more binding partner elements selected from the group consisting of:
  i) MS2 hairpin;
  ii) PP7 hairpin;
  iii) Psi packaging signal;
  iv) Qbeta hairpin; and
  v) U1 hairpin II.

187. The XDP system of any one of embodiments 184-186, wherein the scaffold sequence comprises a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

188. The XDP system of any one of embodiments 184-186, wherein the scaffold sequence of the guide RNA comprises a sequence selected from the group consisting of the sequences set forth in Table 8.

189. The XDP system of any one of embodiments 184-188, wherein the targeting sequence of the guide RNA consists of 14, 15, 16, 17, 18, 19, 20, 21, 22, 23, 24, 25, 26, 27, 28, 29, or 30 consecutive nucleotides.

190. The XDP system of embodiment 189, wherein the targeting sequence has 18, 19 or 20 nucleotides and is complementary to a target nucleic acid sequence.

191. The XDP system of any one of embodiments 163-189, wherein
  (a) the components are encoded on a single nucleic acid;
  (b) the components are encoding on two nucleic acids;
  (c) the components are encoding on three nucleic acids;
  (d) the components are encoding on four nucleic acids; or
  (e) the components are encoding on five nucleic acids.

192. The XDP system of embodiment 191, wherein the one or more of the components encoded by the nucleic acids are configured according to any one of the configurations in Table 11.

193. The XDP system of embodiment 191 or embodiment 192, wherein the one or more of the components are encoded by nucleic acids selected from the group of sequences consisting of SEQ ID NOS: 192, 193, 195, 196, 198-201, 782, 234-339, 880-933, and 947-1000, or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

194. The XDP system of any one of embodiments 165-193, wherein the components are capable of self-assembling into an XDP when the one or more nucleic acids are introduced into a eukaryotic packaging cell and the components are expressed.

195. The XDP of embodiment 194, wherein the therapeutic payload is encapsidated within the XDP upon self-assembly of the XDP in the eukaryotic packaging cell.

196. The XDP system of embodiment 195, wherein the therapeutic payload comprises the CasX variant and the guide RNA complexed as a ribonucleoprotein complex (RNP) and, optionally, a donor template.

197. The XDP system of embodiment 196, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

198. The XDP system of any one of embodiments 186-197, wherein the one or more binding partner elements incorporated into the guide RNA are capable of binding an expressed packaging recruiter incorporated into the Gag polyprotein selected from the group consisting of MS2 coat protein, PP7 coat protein, Qbeta coat protein, nucleocapsid, and U1A signal recognition particle, wherein the binding facilitates the incorporation of the RNP into the XDP during self-assembly.

199. The XDP system of embodiment 198, wherein incorporation of the one or more binding partner elements and the packaging recruiter results in at least a 2-fold, at a least 3-fold, at least a 4-fold, at least a 5-fold increase in editing potency of the XDP for the target nucleic acid compared to XDP without the one or more binding partner elements and the packaging recruiter, when assayed in vitro under comparable conditions.

200. The XDP of any one of embodiments 195, wherein the tropism factor is incorporated on the XDP surface upon self-assembly of the XDP in the eukaryotic packaging cell.

201. The XDP system of embodiment 197, wherein the tropism factor has binding affinity for a cell surface marker of a target cell and facilitates entry of the XDP into the target cell.

202. The XDP system of embodiment 200 or embodiment 201, wherein incorporation of the glycoprotein results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

203. The XDP system of any one of embodiments 196-202, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

204. An XDP system comprising one or more nucleic acid encoding components:
  (a) all or a portion of an Gammaretrovirus Gag polyprotein;
  (b) one or more therapeutic payloads; and
  (c) a tropism factor.

205. The XDP system of embodiment 204, wherein the Gag polyprotein comprises one or more components selected from the group consisting of a matrix polypeptide (MA), a p12 peptide, a capsid polypeptide (CA), and a nucleocapsid polypeptide (NC).

206. The XDP system of embodiment 205, wherein the Gag polyprotein comprises, from N-terminus to C-terminus, matrix polypeptide (MA), a p12 peptide, a capsid polypeptide (CA), and a nucleocapsid polypeptide (NC).

207. The XDP system of any one of embodiments 204-206, wherein the nucleic acids encode one or more components selected from
  (a) HIV p1 peptide;
  (b) HIV p6 peptide;
  (c) HIV Gag-Pol polyprotein;
  (d) MS2 coat protein;
  (e) PP7 coat protein;
  (f) Qbeta coat protein;
  (g) Psi packaging element;
  (h) U1A signal recognition particle;
  (i) phage R-loop;
  (j) Rev protein;
  (k) one or more protease cleavage sites;
  (l) a protease capable of cleaving the cleavage sites; and
  (m) Gag-transframe region-Pol protease polyprotein.

208. The XDP system of any one of embodiments 204-207, wherein the tropism factor is selected from the group consisting of a glycoprotein, an antibody fragment, a receptor, and a ligand to a target cell marker.

209. The XDP system of embodiment 208, wherein the tropism factor is a glycoprotein comprises a sequence selected from the group consisting of the sequences set forth in Table 9, and or is encoded by a sequence of Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

210. The XDP system of embodiment 208, wherein the tropism factor is a glycoprotein comprises a sequence selected from the group consisting of the sequences set forth in Table 9, or is encoded by a sequence of Table 65.

211. The XDP system of embodiment 208, wherein the tropism factor is glycoprotein G from vesicular stomatitis virus (VSV-G).

212. The XDP system of embodiment 211, wherein the VSV-G has a sequence selected from the group consisting of the sequences of Table 9.

213. The XDP system of any one of embodiments 204-212, wherein the therapeutic payload comprises a protein, a nucleic acid, or comprises both a protein and a nucleic acid.

214. The XDP system of embodiment 213, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

215. The XDP system of embodiment 214, wherein the CRISPR protein is a Class 1 or Class 2 CRISPR protein.

216. The XDP system of embodiment 215, wherein the CRISPR protein is a Class 2 CRISPR protein selected from the group consisting of Type II, Type V, or Type VI protein.

217. The XDP system of embodiment 216, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12k, Cas14, CasPhi, CasBeta, and CasX.

218. The XDP system of embodiment 217, wherein the CRISPR protein is a CasX variant comprising a sequence set forth in Table 3, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

219. The XDP system of embodiment 217, wherein the CRISPR protein is a CasX variant comprising a sequence set forth in Table 3.

220. The XDP system of embodiment 218 or embodiment 219, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of SR, RS, (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGGS (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

221. The XDP system of embodiment 213, wherein the therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

222. The XDP system of any one of embodiments 214-220, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

223. The XDP system of embodiment 221 or embodiment 222, wherein the CRISPR guide nucleic acid is a single-molecule guide RNA comprising a scaffold sequence and a targeting sequence, wherein the targeting sequence is complementary to a target nucleic acid sequence.

224. The XDP system of embodiment 223, wherein the single-molecule guide RNA further comprises one or more components selected from the group consisting of:
  i) Stem IIB of Rev response element (RRE),
  ii) Stem II-V of RRE;
  iii) Stem II of RRE
  iv) Rev-binding element (RBE) of Stem IIB; and
  v) and full-length RRE
wherein the one or more components are capable of binding Rev.

225. The XDP system of embodiment 223 or embodiment 224, wherein the single-molecule guide RNA further comprises one or more binding partner elements selected from the group consisting of:
  i) MS2 hairpin;
  ii) PP7 hairpin;
  iii) Psi packaging signal;
  iv) Qbeta hairpin; and
  v) U1 hairpin II.

226. The XDP system of any one of embodiments 223-225, wherein the scaffold sequence comprises a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

227. The XDP system of any one of embodiments 222, wherein the scaffold sequence comprises a sequence selected from the group consisting of the sequences set forth in Table 8.

228. The XDP system of any one of embodiments 222-227, wherein the targeting sequence of the guide RNA consists of 14, 15, 16, 17, 18, 19, 20, 21, 22, 23, 24, 25, 26, 27, 28, 29, or 30 consecutive nucleotides.

229. The XDP system of embodiment 228, wherein the targeting sequence has 18, 19 or 20 nucleotides and is complementary to a target nucleic acid sequence.

230. The XDP system of any one of embodiments 204-229202, wherein
  (a) the components are encoded on a single nucleic acid;
  (b) the components are encoding on two nucleic acids;
  (c) the components are encoding on three nucleic acids;
  (d) the components are encoding on four nucleic acids; or
  (e) the components are encoding on five nucleic acids.

231. The XDP system of embodiment 230, wherein the one or more of the components encoded by the nucleic acids are configured according to any one of the configurations in Table 11.

232. The XDP system of embodiment 230 or embodiment 231, wherein the one or more of the components are encoded by nucleic acids selected from the group of sequences consisting of the sequences set forth in Tables 10, 12, 16, 17, 19, 20, 21, 24, 27, 30, 34, 35, 38, 40, 42, 43, 46, 47, 48, 51, 52, 54, 57, 58, 60, 62, 65, 66, 68, 69, 72, 73, 78, 80, 83, 87, 88, 90 and 104, or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

233. The XDP system of any one of embodiments 230-232, wherein the components are capable of self-assembling into an XDP when the one or more nucleic acids are introduced into a eukaryotic packaging cell and the components are expressed.

234. The XDP of embodiment 233, wherein the therapeutic payload is encapsidated within the XDP upon self-assembly of the XDP in the eukaryotic packaging cell.

235. The XDP system of embodiment 234, wherein the therapeutic payload comprises the CasX variant and the guide RNA complexed as a ribonucleoprotein complex (RNP) and, optionally, a donor template.

236. The XDP system of embodiment 235, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

237. The XDP system of any one of embodiments 225-236, wherein the one or more binding partner elements incorporated into the guide RNA are capable of binding an expressed packaging recruiter incorporated into the Gag polyprotein selected from the group consisting of MS2 coat protein, PP7 coat protein, Qbeta coat protein, nucleocapsid, and U1A signal recognition particle, wherein the binding facilitates the incorporation of the RNP into the XDP during self-assembly.

238. The XDP system of embodiment 237, wherein incorporation of the one or more binding partner elements and the packaging recruiter results in at least a 2-fold, at a least 3-fold, at least a 4-fold, at least a 5-fold increase in editing potency of the XDP for the target nucleic acid compared to XDP without the one or more binding partner elements and the packaging recruiter, when assayed in vitro under comparable conditions.

239. The XDP of any one of embodiments 233-238, wherein the tropism factor is incorporated on the XDP surface upon self-assembly of the XDP in the eukaryotic packaging cell.

240. The XDP system of embodiment 239, wherein the tropism has binding affinity for a cell surface marker of a target cell and facilitates entry of the XDP into the target cell.

241. The XDP system of embodiment 239 or embodiment 240, wherein incorporation of the glycoprotein results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

242. An XDP system comprising one or more nucleic acids encoding one or more components selected from:
(a) all or a portion of a Lentivirus Gag polyprotein;
(b) one or more therapeutic payloads; and
(c) a tropism factor.

243. The XDP system of embodiment 242, wherein the Gag polyprotein comprises one or more components selected from the group consisting of a matrix polypeptide (MA), a capsid polypeptide (CA), a p2 peptide, a nucleocapsid polypeptide (NC), a p1 peptide, and a p6 peptide.

244. The XDP system of embodiment 243, wherein the Gag polyprotein comprises, from N-terminus to C-terminus, matrix polypeptide (MA), a capsid polypeptide (CA), a p2 peptide, a nucleocapsid polypeptide (NC), a p1 peptide, and a p6 peptide.

245. The XDP system of any one of embodiments 242-244, wherein the nucleic acids encode one or more components selected from
(a) HIV Gag-Pol polyprotein;
(b) MS2 coat protein;
(c) PP7 coat protein;
(d) Qbeta coat protein;
(e) Psi packaging element;
(f) U1A signal recognition particle;
(g) phage R-loop;
(h) Rev protein;
(i) one or more protease cleavage sites;
(j) a protease capable of cleaving the cleavage sites; and
(k) Gag-transframe region-Pol protease polyprotein.

246. The XDP system of any one of embodiments 245, wherein the lentivirus is selected from the group consisting of human immunodeficiency-1 (HIV-1), human immunodeficiency-2 (HIV-2), simian immunodeficiency virus (SIV), feline immunodeficiency virus (FIV), and bovine immunodeficiency virus (BIV).

247. The XDP system of embodiment 246, wherein the lentivirus is HIV-1

248. The XDP system of any one of embodiments 242-247, wherein the tropism factor is selected from the group consisting of a glycoprotein, an antibody fragment, a receptor, and a ligand to a target cell marker.

249. The XDP system of embodiment 248, wherein the tropism factor is a glycoprotein comprising a sequence selected from the group consisting of the sequences set forth in Table 9, and or encoded by a sequence of Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

250. The XDP system of embodiment 248, wherein the tropism factor is a glycoprotein comprising a sequence selected from the group consisting of the sequences set forth in Table 9, and or encoded by a sequence of Table 65.

251. The XDP system of embodiment 250, wherein the tropism factor is glycoprotein G from vesicular stomatitis virus (VSV-G).

252. The XDP system of embodiment 251, wherein the VSV-G has a sequence selected from the group consisting of the sequences of Table 9.

253. The XDP system of any one of embodiments 242-252, wherein the therapeutic payload comprises a protein, a nucleic acid, or comprises both a protein and a nucleic acid.

254. The XDP system of embodiment 253, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

255. The XDP system of embodiment 254, wherein the CRISPR protein is a Class 1 or Class 2 CRISPR protein.

256. The XDP system of embodiment 255, wherein the CRISPR protein is a Class 2 CRISPR protein selected from the group consisting of Type II, Type V, or Type VI protein.

257. The XDP system of embodiment 256, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12k, Cas14, CasPhi, CasBeta, and CasX.

258. The XDP system of embodiment 257, wherein the CRISPR protein is a CasX variant comprising a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

259. The XDP system of embodiment 257, wherein the CRISPR protein is a CasX variant comprising a sequence selected from the group consisting of the sequences set forth in Table 8.

260. The XDP system of embodiment 257 or embodiment 259, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of SR, RS, (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

261. The XDP system of embodiment 254, wherein the therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

262. The XDP system of any one of embodiments 253-260, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

263. The XDP system of embodiment 261, wherein the CRISPR guide nucleic acid is a single-molecule guide RNA comprising a scaffold sequence and a targeting sequence, wherein the targeting sequence is complementary to a target nucleic acid sequence.

264. The XDP system of embodiment 262, wherein the single-molecule guide RNA further comprises one or more components selected from the group consisting of:
  i) Stem IIB of Rev response element (RRE),
  ii) Stem II-V of RRE;
  iii) Stem II of RRE
  iv) Rev-binding element (RBE) of Stem IIB; and
  v) and full-length RRE,
wherein the one or more components are capable of binding Rev.

265. The XDP system of embodiment 263 or embodiment 264, wherein the single-molecule guide RNA further comprises one or more binding partner elements selected from the group consisting of:
  i) MS2 hairpin;
  ii) PP7 hairpin;
  iii) Psi packaging signal;
  iv) Qbeta hairpin; and
  v) U1 hairpin II.

266. The XDP system of any one of embodiments 262, wherein the scaffold sequence comprises a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

267. The XDP system of any one of embodiments 263-265, wherein the scaffold sequence of the guide RNA comprises a sequence selected from the group consisting of the sequences set forth in Table 4.

268. The XDP system of any one of embodiments 262-267, wherein the targeting sequence of the guide RNA consists of 14, 15, 16, 17, 18, 19, 20, 21, 22, 23, 24, 25, 26, 27, 28, 29, or 30 consecutive nucleotides.

269. The XDP system of embodiment 268, wherein the targeting sequence has 18, 19 or 20 nucleotides and is complementary to a target nucleic acid sequence.

270. The XDP system of any one of embodiments 241-268, wherein
  (a) the components are encoded on a single nucleic acid;
  (b) the components are encoding on two nucleic acids;
  (c) the components are encoding on three nucleic acids;
  (d) the components are encoding on four nucleic acids; or
  (e) the components are encoding on five nucleic acids.

271. The XDP system of embodiment 269, wherein the one or more of the components encoded by the nucleic acids are configured according to any one of the configurations in Table 11.

272. The XDP system of embodiment 270 or embodiment 271, wherein the one or more of the components are encoded by nucleic acids selected from the group of sequences consisting of the group consisting of the sequences set forth in Tables 10, 12, 16, 17, 19, 20, 21, 24, 27, 30, 34, 35, '38, 40, 42, 43, 46, 47, 48, 51, 52, 54, 57, 58, 60, 62, 65, 66, 68, 69, 72, 73, 78, 80, 83, 87, 88, 90 and 104, or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

273. The XDP system of any one of embodiments 269-272, wherein the components are capable of self-assembling into an XDP when the one or more nucleic acids are introduced into a eukaryotic packaging cell and the components are expressed.

274. The XDP of embodiment 273, wherein the therapeutic payload is encapsidated within the XDP upon self-assembly of the XDP in the eukaryotic packaging cell.

275. The XDP system of embodiment 274, wherein the therapeutic payload comprises a CasX variant and a guide RNA complexed as a ribonucleoprotein complex (RNP) and, optionally, a donor template.

276. The XDP system of embodiment 275, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

277. The XDP system of any one of embodiments 265-276, wherein the one or more binding partner elements incorporated into the guide RNA are capable of binding an expressed packaging recruiter selected from the group consisting of MS2 coat protein, PP7 coat protein, Q□ coat protein, nucleocapsid, and U1A signal recognition particle, wherein the binding facilitates the incorporation of the RNP into the XDP during self-assembly.

278. The XDP of any one of embodiments 273-277, wherein the tropism factor is incorporated on the XDP surface upon self-assembly of the XDP in the eukaryotic packaging cell.

279. The XDP system of embodiment 276, wherein the tropism factor has binding affinity for a cell surface marker of a target cell and facilitates entry of the XDP into the target cell.

280. The XDP system of embodiment 278 or embodiment 279, wherein incorporation of the glycoprotein results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

281. The XDP system of any one of embodiments 275-280, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

282. An XDP system comprising one or more nucleic acid encoding components:
  (a) all or a portion of an Spumaretrovirinae Gag polyprotein;
  (b) one or more therapeutic payloads; and
  (c) a tropism factor.

283. The XDP system of embodiment 282, wherein the Gag polyprotein comprises one or more components selected from the group consisting of a p68 Gag polypeptide and a p3 Gag polypeptide.

284. The XDP system of embodiment 283, wherein the Gag polyprotein comprises, from N-terminus to C-terminus, p68 Gag polypeptide and a p3 Gag polypeptide.

285. The XDP system of any one of embodiments 282-284, wherein the nucleic acids encode one or more components selected from
(a) HIV p1 peptide;
(b) HIV p6 peptide;
(c) HIV Gag-Pol polyprotein;
(d) MS2 coat protein;
(e) PP7 coat protein;
(f) Qbeta coat protein;
(g) Psi packaging element;
(h) U1A signal recognition particle;
(i) phage R-loop;
(j) Rev protein;
(k) one or more protease cleavage sites;
(l) a protease capable of cleaving the cleavage sites; and
(m) Gag-transframe region-Pol protease polyprotein.

286. The XDP system of any one of embodiments 282-285, wherein the tropism factor is selected from the group consisting of a glycoprotein, an antibody fragment, a receptor, and a ligand to a target cell marker.

287. The XDP system of embodiment 286, wherein the tropism factor is a glycoprotein comprising a sequence selected from the group consisting of the sequences set forth in Table 9, or encoded by a sequence of Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

288. The XDP system of embodiment 286, wherein the tropism factor is a glycoprotein comprising a sequence selected from the group consisting of the sequences set forth in Table 9, and or encoded by a sequence of Table 65.

289. The XDP system of embodiment 288, wherein the tropism factor is glycoprotein G from vesicular stomatitis virus (VSV-G).

290. The XDP system of embodiment 289, wherein the VSV-G has a sequence selected from the group consisting of the sequences of Table 9.

291. The XDP system of any one of embodiments 282-290, wherein the therapeutic payload comprises a protein, a nucleic acid, or comprises both a protein and a nucleic acid.

292. The XDP system of embodiment 291, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

293. The XDP system of embodiment 292, wherein the CRISPR protein is a Class 1 or Class 2 CRISPR protein.

294. The XDP system of embodiment 293, wherein the CRISPR protein is a Class 2 CRISPR protein selected from the group consisting of Type II, Type V, or Type VI protein.

295. The XDP system of embodiment 294, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12k, Cas14, CasPhi, CasBeta, and CasX.

296. The XDP system of embodiment 295, wherein the CRISPR protein is a CasX variant comprising a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

297. The XDP system of embodiment 296, wherein the CRISPR protein is a CasX variant comprising a sequence selected from the group consisting of the sequences set forth in Table 8.

298. The XDP system of embodiment 296 or embodiment 297, wherein the CasX variant further comprises one or more NLS selected from the group of sequences consisting of SEQ ID NOS: 35-83 and 1858, wherein the NLS are located at or near the N-terminus and/or the C-terminus and, optionally, the one or more NLS are linked to the CasX variant or to adjacent NLS with a linker peptide wherein the linker peptide is selected from the group consisting of SR, RS, (G)n (SEQ ID NO: 84), (GS)n (SEQ ID NO: 85), (GSGGS)n (SEQ ID NO: 86), (GGSGGS)n (SEQ ID NO: 87), (GGGS)n (SEQ ID NO: 88), GGSG (SEQ ID NO: 89), GGSGG (SEQ ID NO: 90), GSGSG (SEQ ID NO: 91), GSGGG (SEQ ID NO: 92), GGGSG (SEQ ID NO: 93), GSSSG (SEQ ID NO: 94), GPGP (SEQ ID NO: 95), GGP, PPP, PPAPPA (SEQ ID NO: 96), PPPG (SEQ ID NO: 97), PPPGPPP (SEQ ID NO: 98), PPP(GGGS)n (SEQ ID NO: 99), (GGGS)nPPP (SEQ ID NO: 458), AEAAAKEAAAKEAAAKA (SEQ ID NO: 459), and TPPKTKRKVEFE (SEQ ID NO: 460), where n is 1 to 5.

299. The XDP system of embodiment 291, wherein the therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

300. The XDP system of any one of embodiments 292-299, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

301. The XDP system of embodiment 299 or embodiment 300, wherein the CRISPR guide nucleic acid is a single-molecule guide RNA comprising a scaffold sequence and a targeting sequence, wherein the targeting sequence is complementary to a target nucleic acid sequence.

302. The XDP system of embodiment 301, wherein the single-molecule guide RNA further comprises one or more components selected from the group consisting of:
  i) Stem IIB of Rev response element (RRE),
  ii) Stem II-V of RRE;
  iii) Stem II of RRE
  iv) Rev-binding element (RBE) of Stem IIB; and
  v) and full-length RRE,
  wherein the one or more components are capable of binding Rev.

303. The XDP system of embodiment 300 or embodiment 302, wherein the single-molecule guide RNA further comprises one or more binding partner elements selected from the group consisting of:
  i) MS2 hairpin;
  ii) PP7 hairpin;
  iii) Psi packaging signal;
  iv) Qbeta hairpin; and
  v) U1 hairpin II.

304. The XDP system of any one of embodiments 300-303, wherein the scaffold sequence comprises a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

305. The XDP system of any one of embodiments 300-304, wherein the scaffold sequence of the guide RNA comprises a sequence selected from the group consisting of the sequences set forth in Table 8.

306. The XDP system of any one of embodiments 300-305, wherein the targeting sequence of the guide RNA consists of 14, 15, 16, 17, 18, 19, 20, 21, 22, 23, 24, 25, 26, 27, 28, 29, or 30 consecutive nucleotides.

307. The XDP system of embodiment 306, wherein the targeting sequence has 18, 19 or 20 nucleotides and is complementary to a target nucleic acid sequence.

308. The XDP system of any one of embodiments 280-306, wherein
(a) the components are encoded on a single nucleic acid;
(b) the components are encoding on two nucleic acids;
(c) the components are encoding on three nucleic acids;
(d) the components are encoding on four nucleic acids; or
(e) the components are encoding on five nucleic acids.

309. The XDP system of embodiment 308, wherein the one or more of the components encoded by the nucleic acids are configured according to any one of the configurations in Table 11.

310. The XDP system of embodiment 308 or embodiment 309, wherein the one or more of the components are encoded by nucleic acids selected from the group of sequences consisting of selected from the sequences set forth in Tables 10, 12, 16, 17, 19, 20, 21, 24, 27, 30, 34, 35, 38, 40, 42, 43, 46, 47, 48, 51, 52, 54, 57, 58, 60, 62, 65, 66, 68, 69, 72, 73, 78, 80, 83, 87, 88, 90 and 104, or sequences having at least about 85%, at least about 90%, at least about 91%, at least about 92%, at least about 93%, at least about 94%, at least about 95%, at least about 96%, at least about 97%, at least about 98%, or at least about 99% sequence identity thereto.

311. The XDP system of any one of embodiments 308-310, wherein the components are capable of self-assembling into an XDP when the one or more nucleic acids are introduced into a eukaryotic packaging cell and the components are expressed.

312. The XDP of embodiment 311, wherein the therapeutic payload is encapsidated within the XDP upon self-assembly of the XDP in the eukaryotic packaging cell.

313. The XDP system of embodiment 312, wherein the therapeutic payload comprises the CasX variant and the guide RNA complexed as a ribonucleoprotein complex (RNP) and, optionally, a donor template.

314. The XDP system of embodiment 313, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

315. The XDP system of any one of embodiments 303-314, wherein the one or more binding partner elements incorporated into the guide RNA are capable of binding an expressed packaging recruiter selected from the group consisting of MS2 coat protein, PP7 coat protein, Qβ coat protein, nucleocapsid, and U1A signal recognition particle, wherein the binding facilitates the incorporation of the RNP into the XDP during self-assembly.

316. The XDP of any one of embodiments 311-315, wherein the tropism factor is incorporated on the XDP surface upon self-assembly of the XDP in the eukaryotic packaging cell.

317. The XDP system of embodiment 314, wherein the tropism factor has binding affinity for a cell surface marker of a target cell and facilitates entry of the XDP into the target cell.

318. The XDP system of embodiment 316 or embodiment 317, wherein incorporation of the glycoprotein results in at least a 2-fold, at a least 3-fold, at least a 4-fold, at least a 5-fold, at least a 6-fold, at least a 7-fold, or at least an 8-fold increase in editing potency of the XDP for the target nucleic acid compared to XDP without the incorporated glycoprotein, when assayed in vitro under comparable conditions.

319. The XDP system of any one of embodiments 313-318, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

320. The XDP system of any one of the preceding embodiments, wherein the Gag polyprotein and the therapeutic payload is expressed as a fusion protein.

321. The XDP system of embodiment 320, wherein the fusion protein does not comprise a protease cleavage site between the Gag polyprotein and the therapeutic payload.

322. The XDP system of embodiment 320, wherein the fusion protein comprises a protease cleavage site between the Gag polyprotein and the therapeutic payload.

323. The XDP system of any one of embodiments 320-322, wherein the fusion protein comprises protease cleavage sites between the components of the Gag polyprotein.

324. The XDP system of embodiment 322 and/or embodiment 323, wherein the cleavage sites are capable of being cleaved by the protease of the Gag-Pol polyprotein, the protease of the Gag-transframe region-Pol protease polyprotein, or a non-retroviral, heterologous protease.

325. The XDP system of embodiment 324, wherein the cleavage sites are capable of being cleaved by the protease of the Gag-transframe region-Pol protease polyprotein.

326. The XDP system of embodiment 324, wherein the cleavage sites are capable of being cleaved by the protease of the Gag-Pol polyprotein 327. The XDP system of embodiment 324, wherein the non-retroviral, heterologous protease is selected from the group consisting of tobacco etch virus protease (TEV), potyvirus HC protease, potyvirus P1 protease, PreScission (HRV3C protease), b virus NIa protease, B virus RNA-2-encoded protease, aphthovirus L protease, enterovirus 2A protease, rhinovirus 2A protease, picorna 3C protease, comovirus 24K protease, nepovirus 24K protease, RTSV (rice tungro spherical virus) 3C-like protease, parsnip yellow fleck virus protease, 3C-like protease, heparin, cathepsin, thrombin, factor Xa, metalloproteinase, and enterokinase.

328. The XDP system of embodiment 327, wherein the non-retroviral, heterologous protease is PreScission (HRV3C protease).

329. The XDP system of embodiment 327, wherein the non-retroviral, heterologous protease is tobacco etch virus protease (TEV).

330. A eukaryotic cell comprising the XDP system of any one of the preceding embodiments.

331. The eukaryotic cell of embodiment 330, wherein the cell is a packaging cell.

332. The eukaryotic cell of embodiment 330 or embodiment 331, wherein the eukaryotic cell is selected from the group consisting of HEK293 cells, HEK293T cells, Lenti-X 293T cells, BHK cells, HepG2, Saos-2, HuH7, NS0 cells, SP2/0 cells, YO myeloma cells, A549 cells, P3X63 mouse myeloma cells, PER cells, PER.C6 cells, hybridoma cells, VERO, NIH3T3 cells, COS, W138, MRCS, A549, HeLa cells, CHO cells, and HT1080 cells.

333. The eukaryotic cell of embodiment 331 or embodiment 332, wherein the packaging cell is modified to reduce expression of a cell surface marker.

334. The eukaryotic cell of embodiment 333, wherein the cell surface marker is selected from the group consisting of B2M, CD47 and HLA-E KI, wherein the incorporation of the cell surface marker on the surface of the XDP released from the packaging cell is reduced compared to XDP released from a packaging cell that has not be modified.

335. The eukaryotic cell of any one of embodiments 331-334, wherein the packaging cell is modified to express one or more cell surface markers selected from CD46, CD47, CD55, and CD59, wherein the incorporation of the cell surface marker on the surface of the XDP released from the packaging cell is increased compared to XDP released from a packaging cell that has not be modified.

336. A method of making an XDP comprising a therapeutic payload, the method comprising:
(a) propagating the packaging cell of any one of embodiments 331-335 under conditions such that XDPs are produced; and
(b) harvesting the XDPs produced by the packaging cell.

337. The method of embodiment 336, wherein the packaging cell is HEK293T.

338. The method of embodiment 336 or embodiment 337, wherein expression of the incorporated binding partner element(s) and packaging recruiter(s) results in at least a 2-fold, at a least 3-fold, or at least a 4-fold increase in editing potency of the XDP compared to XDP without the incorporated binding partner element(s) and packaging recruiter(s), when assayed in vitro under comparable conditions.

339. An XDP produced by the method of any one of embodiments 336-338.

340. The XDP of embodiment 339, comprising a therapeutic payload of one or more RNPs of the CasX variant and the guide RNA and, optionally, a donor template.

341. A method of modifying a target nucleic acid sequence in a population of cells, the method comprising contacting the cells with the XDP of embodiment 339 or embodiment 340, wherein said contacting comprises introducing the into the cell the RNP and, optionally, the donor template nucleic acid sequence, wherein the target nucleic acid targeted by the guide RNA is modified by the CasX variant.

342. The method of embodiment 341, wherein the RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

343. The method of embodiment 341 or embodiment 342, wherein the modification comprises introducing one or more single-stranded breaks in the target nucleic acid sequence.

344. The method of embodiment 341 or embodiment 342, wherein the modification comprises introducing one or more double-stranded breaks in the target nucleic acid sequence.

345. The method of any one of embodiments 341-344, wherein the modification comprises introducing an insertion, deletion, substitution, duplication, or inversion of one or more nucleotides in the target nucleic acid sequence of the cells.

346. The method of any one of embodiments 341-345, wherein the modification comprises insertion of the donor template into the target nucleic acid sequence of the cells.

347. The method of any one of embodiments 341-346, wherein the cells are modified in vitro or ex vivo.

348. The method of any one of embodiments 341-346, wherein the cells are modified in vivo.

349. The method of embodiment 348, wherein the XDP is administered to a subject.

350. The method of embodiment 349, wherein the subject is the subject is selected from the group consisting of mouse, rat, pig, non-human primate, and human.

351. The method of embodiment 349 or embodiment 350, wherein the XDP is administered by a route of administration selected from the group consisting of subcutaneous, intradermal, intraneural, intranodal, intramedullary, intramuscular, intravenous, intracerebroventricular, intracisternal, intrathecal, intracranial, intralumbar, intratracheal, intraosseous, inhalatory, intracontralateral striatum, intraocular, intravitreal, intralymphatical, intraperitoneal and sub-retinal routes.

352. The method of any one of embodiments 349-351, wherein the XDP is administered to the subject using a therapeutically effective dose.

353. The method of embodiment 352, wherein the XDP is administered at a dose of at least about $1\times10^5$ particles/kg, or at least about $1\times10^6$ particles/kg, or at least about $1\times10^7$ particles/kg, or at least about $1\times10^8$ particles/kg, or at least about $1\times10^9$ particles/kg, or at least about $1\times10^{10}$ particles/kg, or at least about $1\times10^{11}$ particles/kg, or at least about $1\times10^{12}$ particles/kg, or at least about $1\times10^{13}$ particles/kg, or at least about $1\times10^{14}$ particles/kg, or at least about $1\times10^{15}$ particles/kg, or at least about $1\times10^{16}$ particles/kg.

354. The method of any one of embodiments 349-353, wherein the XDP is administered to the subject according to a treatment regimen comprising one or more consecutive doses using a therapeutically effective dose of the XDP.

355. The method of embodiment 354, wherein the therapeutically effective dose is administered to the subject as two or more doses over a period of at least two weeks, or at least one month, or at least two months, or at least three months, or at least four months, or at least five months, or at least six months, or once a year, or every 2 or 3 years.

356. A method for introducing a CasX variant and gNA RNP into a cell having a target nucleic acid, comprising contacting the cell with the XDP of embodiment 339 or embodiment 340, such that the RNP enters the cell.

357. The method of embodiment 356, wherein the RNP binds to the target nucleic acid.

358. The method of embodiment 357, wherein the target nucleic acid is cleaved by the CasX variant.

359. The method of any one of embodiments 356-358, wherein the cell is modified in vitro.

360. The method of any one of embodiments 356-358, wherein the cell is modified in vivo.

361. The method of embodiment 360, wherein the XDP is administered to a subject.

362. The method of embodiment 361, wherein the subject is the subject is selected from the group consisting of mouse, rat, pig, non-human primate, and human.

363. The method of any one of embodiments 360-362, wherein the XDP is administered to the subject using a therapeutically effective dose.

364. The method of embodiment 363, wherein the XDP is administered at a dose of at least about $1\times10^5$ particles/kg, or at least about $1\times10^6$ particles/kg, or at least about $1\times10^7$ particles/kg, or at least about $1\times10^8$ particles/kg, or at least about $1\times10^9$ particles/kg, or at least about $1\times10^{10}$ particles/kg, or at least about $1\times10^{11}$ particles/kg, or at least about $1\times10^{12}$ particles/kg, or at least about $1\times10^{13}$ particles/kg, or at least about $1\times10^{14}$ particles/kg, or at least about $1\times10^{15}$ particles/kg, or at least about $1\times10^{16}$ particles/kg.

365. A XDP particle comprising:
(a) a retroviral matrix (MA) polypeptide;
(b) a therapeutic payload encapsidated within the XDP; and
(c) a tropism factor incorporated on the XDP surface.

366. The XDP particle of embodiment 365, further comprising one or more retroviral components selected from:
(a) a capsid polypeptide (CA);
(b) a nucleocapsid polypeptide (NC);
(c) a P2A peptide, a P2B peptide;
(d) a P10 peptide;
(e) a p12 peptide
(f) a PP21/24 peptide;
(g) a P12/P3/P8 peptide;
(h) a P20 peptide;
(i) a p1 peptide; and
(j) a p6 peptide 367. The XDP particle of embodiment 365 or embodiment 366, wherein the tropism factor is selected from the group consisting of a glycoprotein, an antibody fragment, a receptor, and a ligand to a target cell marker.

368. The XDP particle of embodiment 367, wherein the tropism factor is a glycoprotein comprising a sequence selected from the group consisting of the sequences set forth in Table 9, or is encoded by a sequence of Table 65, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

369. The XDP particle of embodiment 367, wherein the tropism factor is a glycoprotein comprising an encoding sequence selected from the group consisting of the sequences set forth in Table 9, or is encoded by a sequence of Table 65.

370. The XDP particle of any one of embodiments 365-369, wherein the therapeutic payload comprises a protein, a nucleic acid, or comprises both a protein and a nucleic acid.

371. The XDP particle of embodiment 370, wherein the protein payload is selected from the group consisting of a cytokine, an interleukin, an enzyme, a receptor, a microprotein, a hormone, erythropoietin, RNAse, DNAse, a blood clotting factor, an anticoagulant, a bone morphogenetic protein, an engineered protein scaffold, a thrombolytic protein, a CRISPR protein, granulocyte-macrophage colony-stimulating factor (GMCSF), transcription factor, transposon, reverse transcriptase, viral interferon antagonists, tick protein, and an anti-cancer modality.

372. The XDP particle of embodiment 371, wherein the CRISPR protein is a Class 1 or Class 2 CRISPR protein.

373. The XDP particle of embodiment 372, wherein the CRISPR protein is a Class 2 CRISPR protein selected from the group consisting of Type II, Type V, or Type VI protein.

374. The XDP particle of embodiment 373, wherein the CRISPR protein is a Type V protein selected from the group consisting of Cas12a, Cas12b, Cas12c, Cas12d (CasY), Cas12f, Cas12g, Cas12h, Cas12i, Cas12j, Cas12k, Cas14, CasPhi, CasBeta, and CasX.

375. The XDP particle of embodiment 374, wherein the CRISPR protein is a CasX variant comprising a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

376. The XDP particle of embodiment 374, wherein the CRISPR protein is a CasX variant comprising a sequence selected from the group consisting of the sequences set forth in Table 8.

377. The XDP particle of embodiment 370, wherein the therapeutic payload is a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

378. The XDP system of any one of embodiments 365-377, further comprising a therapeutic payload comprising a nucleic acid selected from the group consisting of a single-stranded antisense oligonucleotide (ASOs), a double-stranded RNA interference (RNAi) molecule, a DNA aptamer, an RNA aptamer, and a CRISPR guide nucleic acid.

379. The XDP particle of embodiment 378, wherein the CRISPR guide nucleic acid is a single-molecule guide RNA comprising a scaffold sequence and a targeting sequence, wherein the targeting sequence comprises between 14 and 30 nucleotides and is complementary to a target nucleic acid sequence.

380. The XDP system of embodiment 379, wherein the single-molecule guide RNA further comprises one or more components selected from the group consisting of:
i) Stem IIB of Rev response element (RRE),
ii) Stem II-V of RRE;
iii) Stem II of RRE;
iv) Rev-binding element (RBE) of Stem IIB; and
v) and full-length RRE.

381. The XDP system of embodiment 379 or embodiment 380, wherein the single-molecule guide RNA further comprises one or more binding partner elements selected from the group consisting of:
i) MS2 hairpin;
ii) PP7 hairpin;
iii) Psi packaging signal;
iv) Qbeta hairpin; and
v) U1 hairpin II.

382. The XDP particle of any one of embodiments 379-381, wherein the scaffold sequence comprises a sequence selected from the group consisting of the sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto.

383. The XDP particle of any one of embodiments 379-381, wherein the scaffold sequence comprises a sequence selected from the group consisting of the sequences set forth in Table 8.

384. The XDP particle of any one of embodiments 378-383, wherein the therapeutic payload comprises the CasX variant and the guide RNA complexed as a ribonucleoprotein complex (RNP) and, optionally, a donor template.

385. The XDP particle of embodiment 384, wherein an RNP of the CasX variant and the guide RNA variant exhibits at least a 2-fold improvement in cleavage velocity of a target nucleic acid compared to an RNP of a reference CasX and a reference guide RNA, when assayed in vitro under comparable conditions.

386. The XDP system of embodiment 384 or embodiment 385, wherein the XDP further comprises a therapeutic payload selected from the group consisting of a single-stranded antisense oligonucleotide (ASOs), a double-stranded RNA interference (RNAi) molecule, a DNA aptamer, an RNA aptamer, a cytokine, an interleukin, an enzyme, a receptor, a microprotein, a hormone, erythropoietin, ribonuclease (RNAse), deoxyribonuclease (DNAse), a blood clotting factor, an anticoagulant, a bone morphogenetic protein, an engineered protein scaffold, a thrombolytic protein, granulocyte-macrophage colony-stimulating factor (GMCSF), a transcription factor, a transposon, reverse transcriptase, viral interferon antagonists, a tick protein, and an anti-cancer modality.

387. The XDP particle of any one of embodiments 365-386, wherein the retroviral components are derived from a Orthoretrovirinae virus or a Spumaretrovirinae virus.

388. The XDP particle of embodiment 387, wherein the Orthoretrovirinae virus is selected from the group consisting of Alpharetrovirus, Betaretrovirus, Deltaretrovirus, Epsilonretrovirus, Gammaretrovirus, and Lentivirus.

389. The XDP particle of embodiment 387, wherein the Spumaretrovirinae virus is selected from the group consisting of Bovispumavirus, Equispumavirus, Felispumavirus, Prosimiispumavirus, Simiispumavirus, and Spumavirus.

390. The XDP particles, or the XDP systems of any one of the preceding embodiments, for use as a medicament for the treatment of a subject having a disease.

EXAMPLES

Example 1: Generating CasX Variant Constructs

CasX variants were generated using standard molecular biology cloning methods, as well as the methods detailed in US20220081681A1 (U.S. patent application Ser. No. 17/533,997). The following methods provide a general outline of the methods employed. In order to generate the CasX 488 construct (sequences in Table 12), the codon-optimized CasX 119 construct (based on the CasX Stx2 construct, encoding Planctomycetes CasX SEQ ID NO: 2, with amino acid substitutions and deletions) was cloned into a destination plasmid (pStX) using standard cloning methods. In order to generate the CasX 491 construct (sequences in Table 12), the codon-optimized CasX 484 construct (based on the CasX Stx2 construct, encoding Planctomycetes CasX SEQ ID NO: 2, with substitutions and deletions of certain amino acids, with fused NLS, and linked guide and non-targeting sequences) was cloned into a destination plasmid (pStX) using standard cloning methods. Construct CasX 1 (CasX SEQ ID NO: 1) was cloned into a destination vector using standard cloning methods. To build CasX 488, the CasX 119 construct DNA was PCR amplified in two reactions using Q5 DNA polymerase according to the manufacturer's protocol, using universal appropriate primers. To build CasX 491, the codon optimized CasX 484 construct DNA was PCR amplified in two reactions using Q5 DNA polymerase according to the manufacturer's protocol, using appropriate primers. The CasX 1 construct was PCR amplified in two reactions using Q5 DNA polymerase according to the manufacturer's protocol, universal appropriate primers. Each of the PCR products were purified by gel extraction from a 1% agarose gel and the corresponding fragments were then pieced together using standard methods. Assembled products in pStx1 were transformed into chemically-competent Turbo Competent E. coli bacterial cells, plated on LB-Agar plates containing kanamycin. Individual colonies were picked and miniprepped using Qiagen spin Miniprep Kit following the manufacturer's protocol. The resultant plasmids were sequenced using Sanger sequencing to ensure correct assembly.

The foregoing methods were used to build CasX 515, 527, 535-537, 583, 660-664, 668, 670, 672, 676, and 677 using CasX4 88 or 491 with substitutions and deletions of certain amino acids. Encoding and amino acid sequences are listed in Table 12.

The expression and recovery of the CasX constructs was performed using standard chromatograph methodologies, including the methods of WO2020247882A1, incorporated by reference herein.

CasX variant 488: The average yield was 2.7 mg of purified CasX protein per liter of culture at 98.8% purity, as evaluated by colloidal Coomassie staining.

CasX Variant 491: The average yield was 12.4 mg of purified CasX protein per liter of culture at 99.4% purity, as evaluated by colloidal Coomassie staining.

CasX variant 515: The average yield was 7.8 mg of purified CasX protein per liter of culture at 90% purity, as evaluated by colloidal Coomassie staining.

CasX variant 526: The average yield was 13.79 mg per liter of culture, at 93% purity. Purity was evaluated by colloidal Coomassie staining.

CasX variant 668: The average yield was 3.32 mg per liter of culture, at 93% purity. Purity was evaluated by colloidal Coomassie staining.

CasX variant 672: The average yield was 6.50 mg per liter of culture, at 88% purity. Purity was evaluated by colloidal Coomassie staining.

CasX variant 676: The average yield was 5.05 mg per liter of culture, at 92% purity. Purity was evaluated by colloidal Coomassie staining.

CasX variant 677: The average yield was 2.93 mg per liter of culture, at 81% purity. Purity was evaluated by colloidal Coomassie staining.

TABLE 12

Sequences of CasX variants

| Construct | DNA Sequence SEQ ID NO | Amino Acid Sequence SEQ ID NO |
| --- | --- | --- |
| CasX 488 | 923 | 937 |
| CasX 491 | 924 | 938 |
| CasX 515 | 925 | 939 |
| CasX 527 | 926 | 940 |
| CasX 535 | 927 | 941 |
| CasX 536 | 928 | 942 |
| CasX 537 | 929 | 943 |
| CasX 583 | 930 | 944 |
| CasX 660 | 931 | 945 |
| CasX 661 | 932 | 946 |

TABLE 12-continued

Sequences of CasX variants

| Construct | DNA Sequence SEQ ID NO | Amino Acid Sequence SEQ ID NO |
|---|---|---|
| CasX 662 | 933 | 947 |
| CasX 663 | 934 | 948 |
| CasX 664 | 935 | 949 |
| CasX 668 | 936 | 950 |
| CasX 670 | 35040 | 35044 |
| CasX 672 | 35041 | 35045 |
| CasX 676 | 35042 | 35046 |
| CasX 677 | 35043 | 35047 |

Example 2: The PASS Assay Identifies CasX Protein Variants with Enhanced Editing Activity Relative to CasX 491 or CasX 119

The purpose of the experiment was to identify variants of CasX with improved editing in human cells, relative to CasX 491 or 119. To accomplish this, the HEK293 cell line PASS V1.01 was treated with the wild-type CasX protein 2 or with engineered CasX protein variants 119 or 491 or another CasX protein variant, and Next-generation sequencing (NGS) was performed to calculate the percent editing at a variety of spacers and associated target sites.

Materials and Methods: A multiplexed pooled approach was taken to assay clonal protein variants using the PASS system. Briefly, a pooled HEK cell line was generated and termed PASS V1.01. Each cell within the pool contained a genome-integrated single-guide RNA (sgRNA), paired with a specific target site (listed in Table 13). After transfection of protein-expression constructs, editing at a specific target by a specific spacer could be quantified by NGS. Each guide-target pair was designed to provide data related to activity, specificity, and targetability of the CasX-guide RNP complex.

Paired spacer-target sequences were synthesized by Twist Biosciences and obtained as an equimolar pool of oligonucleotides. This pool was amplified by PCR and cloned by Golden Gate cloning to generate a final library of plasmids named p77. Each plasmid contained a sgRNA expression element and a target site, along with a GFP expression element. The sgRNA expression element consisted of a U6 promoter driving transcription of gRNA scaffold 174 (SEQ ID NO: 2238), followed by a spacer sequence which would target the RNP of the guide and CasX variant to the paired target site. 250 possible unique, paired spacer-target synthetic sequences were designed and synthesized. A pool of lentivirus was then produced from this plasmid library using the LentiX production system (Takara Bio USA, Inc) according to the manufacturer's instructions. The resulting viral preparation was then quantified by qPCR and transduced into a standard HEK293 cell line at a low multiplicity of infection so as to generate single copy integrations. The resulting cell line was then purified by fluorescence-activated cell sorting (FACS) to complete the production of PASS V1.01. This cell line was then seeded in six-well plate format and treated either in duplicate or as a single sample with either water or was transfected with 2 μg of plasmid p67, delivered by Lipofectamine Transfection Reagent (ThermoFisher) according to the manufacturer's instructions. Plasmid p67 contains an EF-1a promoter driving expression of a CasX protein tagged with the SV40 Nuclear Localization Sequence as well as a puromycin resistance gene. After one day, cells were transferred to media selective for puromycin resistance (Sigma). After an additional four days, treated PASS V1.01 cells were collected, lysed, and genomic DNA was extracted using a genomic DNA isolation kit (Zymo Research). Genomic DNA was then PCR amplified with custom primers to generate amplicons compatible with Illumina NGS and sequenced on a NextSeq instrument. Sample reads were demultiplexed and filtered for quality. Editing outcome metrics (fraction of reads with indels) were then quantified for each spacer-target synthetic sequence across treated samples.

To assess the editing activity of a CasX nuclease at human target sites, 48 TTC PAM target sites were quantified. The average editing efficiency and standard error of the mean for two biological replicates was calculated for each of these spacers where indicated. The average editing efficiency across the 48 spacers also calculated, along with the propagated standard error of the mean, where indicated.

Figure 1:
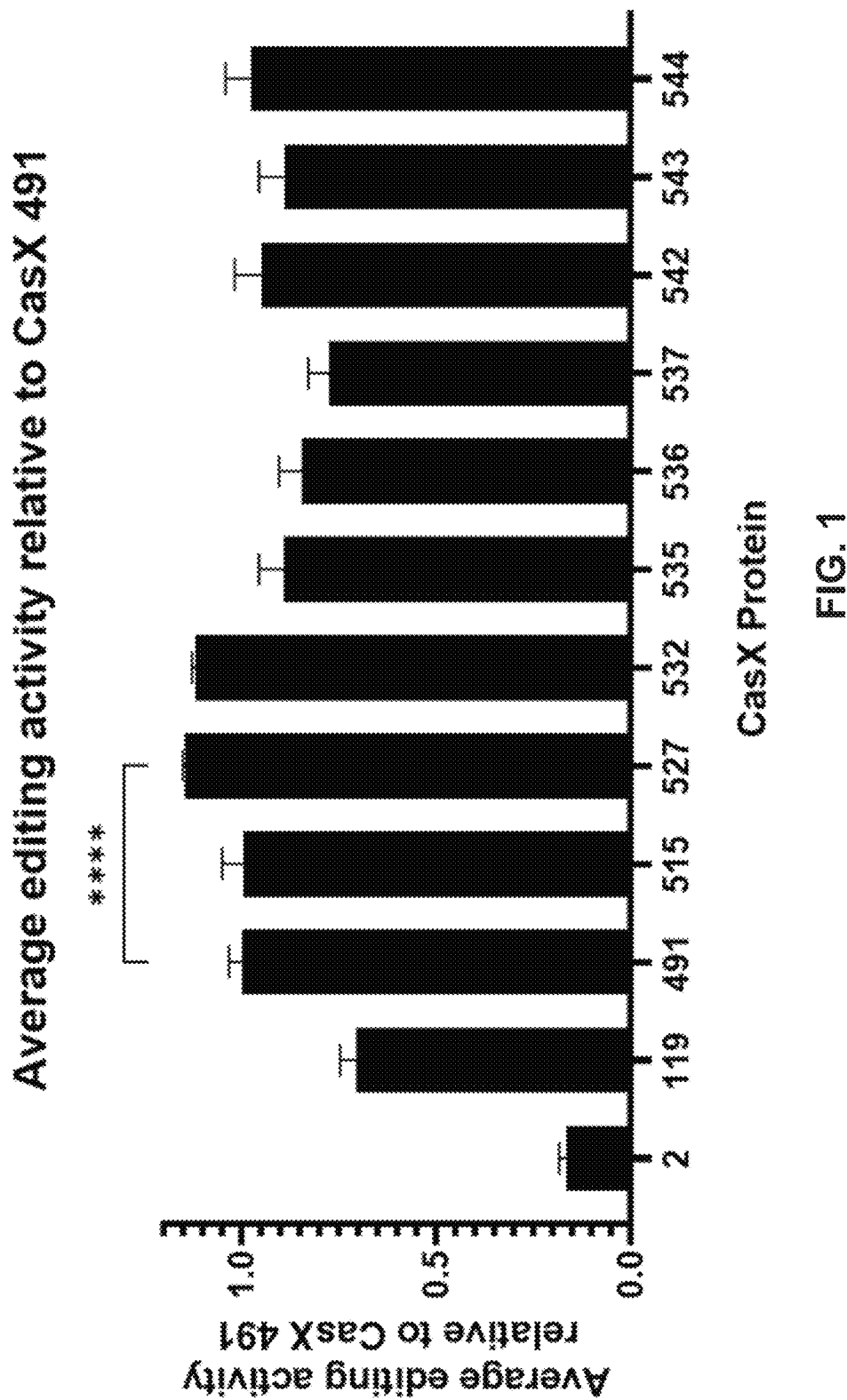
FIG. 1 is a bar plot of select CasX variant proteins and their editing efficiency relative to CasX 491 at 48 TTC PAM target sites, as described in Example 2. Data are presented as average relative editing efficiency where 1.0 is equal to the editing of CasX 491. Error is +/−the propagated SEM for duplicate samples.

Results: FIG. 1 is a bar plot showing the average editing efficiency, relative to CasX 491, of select CasX nucleases at 48 different TTC PAM target sites in human cells. The propagated standard error of the mean of two experiments plotted as error bars. These data indicate that both CasX 119 and 491 are substantially more efficient than wild-type CasX 2. In addition, CasX 515 is not significantly different compared to the editing efficiency of CasX 491. Surprisingly, CasX 527 exhibited improved efficiency compared to 491 at TTC PAM sequences (p=0.0000635 by Welch's two-tailed t-test). CasX nuclease 527 was engineered to exhibit improved editing efficiency at PAM sequences of ATC, CTC, or GTC, potentially by stabilizing the R-loop structure of the CasX ribonuclear protein (RNP) with double-stranded DNA target sites with non-canonical PAM sequences. CasX 527 consists of an arginine amino acid inserted at position 26 of CasX 491. This position is physically proximal to the interaction of the CasX PAM recognition loop (amino acid position 223) with the PAM nucleotides of the DNA non-target strand (NTS).

Figure 2:
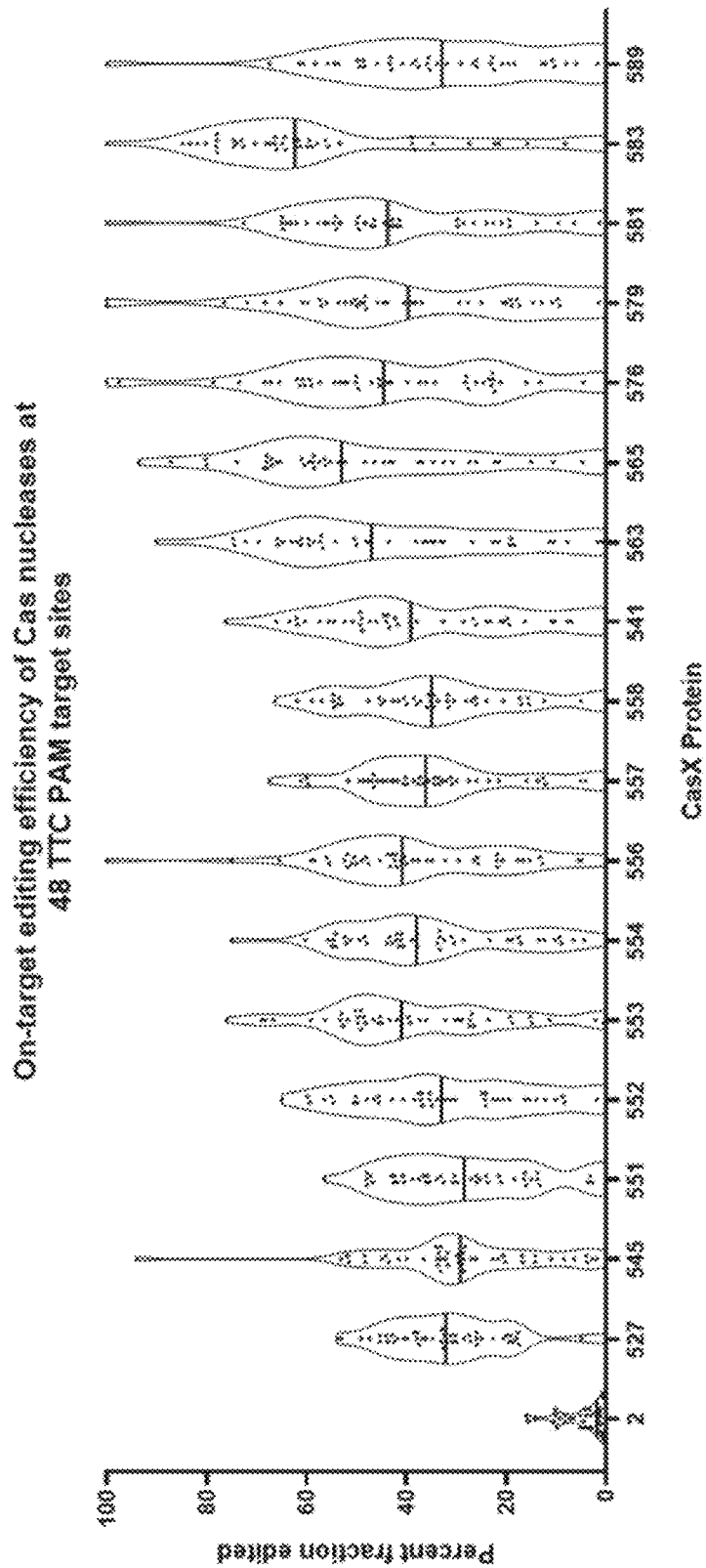
FIG. 2 is a violin plot of select CasX variant proteins and their editing efficiency at 48 TTC PAM target sites as described in Example 2.

FIG. 2 is a violin plot comparing the editing efficiency of CasX 2 and 527 to select variants of CasX 515 at 48 TTC PAM spacers, with the median editing efficiency represented as a horizontal bar. As discussed above, CasX 527 was previously observed to have editing efficiency equal to or better than CasX 491, and several novel CasX variants were here observed to have further improved editing efficiency relative to CasX 527. Unexpectedly, the editing rates for CasX 583 were particularly uniform and high. This may be the result of a large improvement in the stability of the R-loop structure, such that editing variation typically observed between spacers was mostly overcome. Supporting this hypothesis, CasX 583 differs from CasX 515 by the substitution of a hydrophobic leucine at position 168 for a positively charged lysine in the non-target strand binding domain (NTSB) of the protein, which may facilitate additional ionic bonds to the NTS of the target DNA. This region is unstructured in the CryoEM structure discussed above and the NTSB domain has been labeled for clarity. Table 13 lists the editing efficiency for 48 TTC PAM spacers when targeted with CasX protein variant 527 or 583, demonstrating the enhanced editing efficiency of the CasX 583 at the majority of the targets. The spacer name and associated PAM sequence are indicated.

Figure 3:
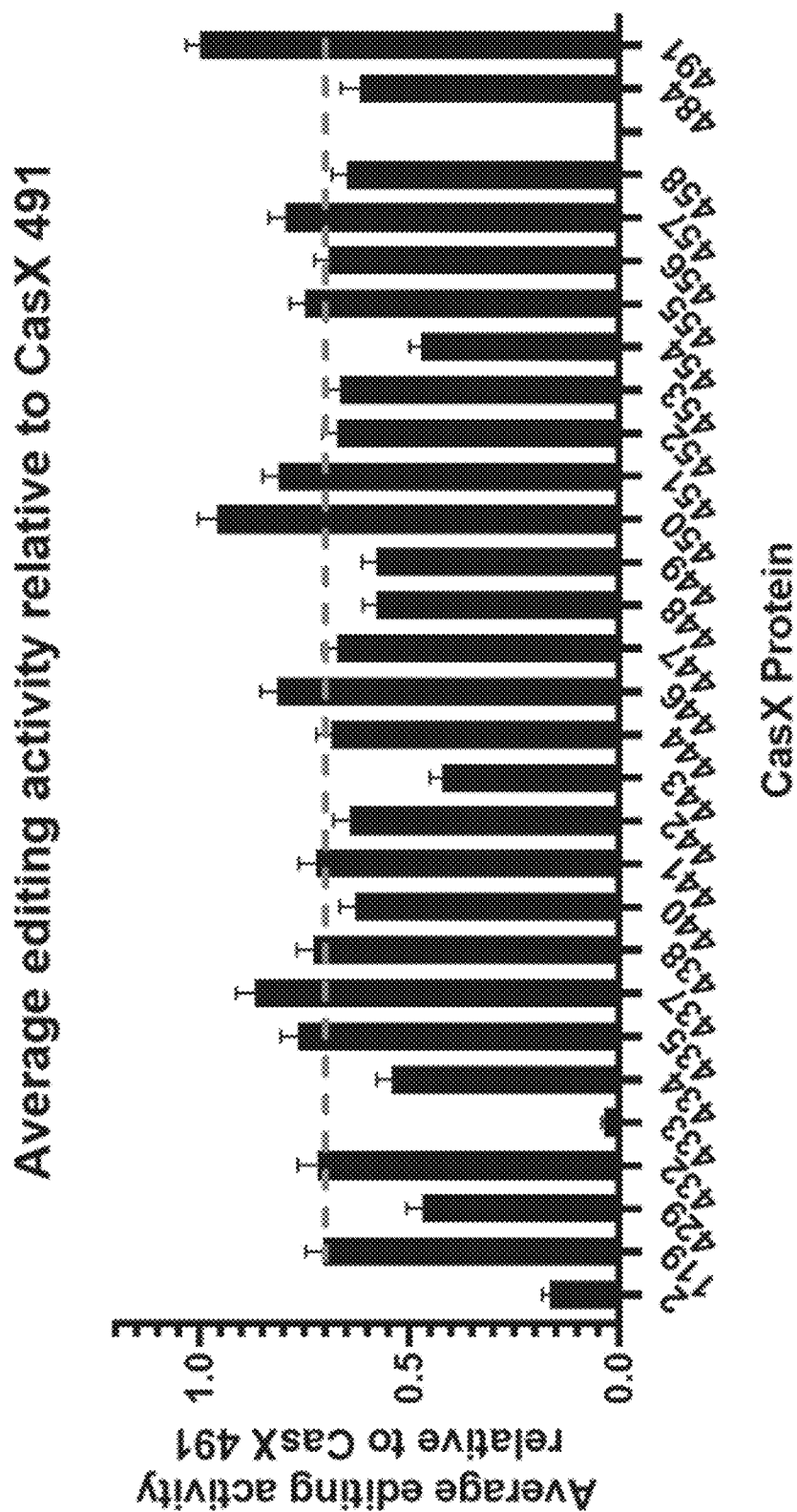
FIG. 3 is a bar plot of select CasX variant proteins and their editing efficiency relative to CasX 491 at 48 TTC PAM target sites, as described in Example 2. Data are presented as average relative editing efficiency where 1.0 is equal CasX 491 editing. The grey dashed line illustrates the editing efficiency of CasX 119. Error is +/−the propagated SEM for duplicate samples.

FIG. 3 is a bar plot showing the average editing efficiency, relative to CasX 491, of select CasX nucleases at 48 different TTC PAM target sites in human cells. The propagated standard error of the mean of two experiments plotted as error bars. The grey dashed line indicates the editing activity of CasX 119. These data indicate that CasX variants from 429 to 458 exhibit variable editing efficiency relative to CasX 119, and in some cases exhibit improved editing efficiency relative to CasX 119, which edits at 70.8% relative to CasX 491. In particular, CasX 450 was substantially more efficient than CasX 119, editing at 95.9% relative to CasX 491, and consists of four substitution mutations relative to the CasX 119 sequence. These four substitution mutations are as follows: D732N, E385P, Y857R, I658V. Importantly, CasX 449 consists of the same sequence, minus the substitution of I658V, and is considerably less efficient, editing at only 58.1% relative to CasX 491. This comparison indicates that this mutation is of critical importance for the increase in activity. These data demonstrate that improved editing activity is achievable when combinations of substitution mutations are made to CasX 119. Notably, these enhancements to activity are separate from the enhancements observed to arise from domain exchange between homologous CasX protein sequences. In particular, CasX 484 differs from CasX 491 only by replacement of the CasX 2 domains NTSB and Helical Ib with those found CasX 1, with a corresponding increase in activity from 62.0% to 100.0%. These data show that CasX 119 nuclease activity can be enhanced by combinations of individual substitution mutations or by domain exchange with homologous CasX proteins.

Under the conditions of the experiments, a set of variants of CasX protein 491 or 515 were identified that are improved for double-stranded DNA cleavage in human cells at target DNA sequences associated with a PAM of sequence TTC, and provide evidence of specific locations or combinations of locations for mutations that could be used to further engineer CasX variants molecules with enhanced activity for a target DNA sequence of interest.

TABLE 13

Percent editing of CasX 527 or CasX 583 at 48 spacers associated with PAM sequences of TTC

| Spacer Name | CasX 527 Percent Editing | CasX 583 Percent Editing |
|---|---|---|
| Rho_11.24 | 26.0 | 38.9 |
| SOD1_8.89 | 25.9 | 38.9 |
| SOD1_8.57 | 42.4 | 22.2 |
| DMD_16.29 | 5.0 | 0.0 |
| DMD_16.30 | 33.0 | 62.5 |
| DMD_16.31 | 44.1 | 70.3 |
| DMD_16.32 | 19.1 | 66.3 |
| BCL11A_21.1 | 53.1 | 74.0 |
| PCSK9_6.8 | 25.9 | 57.9 |
| HTT_5.1 | 45.3 | 74.6 |
| DMPK_20.7 | 19.9 | 56.3 |
| B2M_7.9 | 53.9 | 72.7 |
| B2M_7.37 | 32.5 | 59.9 |
| CD70_26.5 | 37.7 | 66.0 |
| CD70_26.3 | 27.2 | 78.0 |
| FSHD_25.1 | 19.4 | 0.0 |
| PMP22_18.22 | 31.9 | 66.4 |
| PTBP1_28.1 | 17.4 | 0.0 |
| Rho_11.2 | 32.4 | 59.5 |
| VCV000162497_alt | 22.6 | 27.4 |
| VCV000037426_alt | 34.7 | 34.7 |
| VCV000052759_alt | 43.8 | 84.8 |
| VCV000031157_alt | 27.5 | 0.0 |
| VCV000217157_alt | 17.7 | 21.4 |
| VCV000048146_alt | 36.8 | 53.3 |
| VCV000039614_alt | 42.9 | 73.1 |
| VCV000217646_alt | 39.7 | 81.8 |
| VCV000408199_alt | 28.5 | 64.2 |
| VCV000431973_alt | 40.6 | 62.2 |
| VCV000004193_alt | 18.7 | 15.8 |
| VCV000003920_alt | 31.1 | 68.1 |
| VCV000224616_alt | 20.6 | 58.9 |
| VCV000004787_alt | 37.9 | 61.7 |
| VCV000013115_alt | 0.0 | 100.0 |
| VCV000195355_alt | 45.3 | 83.3 |
| VCV000190123_alt | 49.1 | 78.1 |
| VCV000048535_alt | 32.9 | 61.2 |
| VCV000468648_alt | 38.4 | 77.9 |
| VCV000000908_alt | 30.7 | 64.3 |
| VCV000066016_alt | 0.0 | 0.0 |
| VCV000184702_alt | 41.8 | 8.1 |
| VCV000003825_alt | 30.2 | 55.7 |
| VCV000014243_alt | 36.2 | 77.9 |
| VCV000046102_alt | 47.3 | 74.6 |
| VCV000050962_alt | 24.9 | 67.4 |
| VCV000011908_alt | 30.0 | 64.8 |
| VCV000252575_alt | 17.9 | 38.3 |
| SOD1_G93A_alt | 37.5 | 80.2 |

Example 3: Generation of RNA Guides

For the generation of RNA single guides and spacers, templates for in vitro transcription were generated by performing PCR with Q5 polymerase (NEB M0491) according to the recommended protocol, with template oligos for each backbone and amplification primers with the T7 promoter and the spacer sequence. The DNA primer sequences for the T7 promoter, guide and spacer for guides and spacers are presented in Table 14, below. The template oligos, labeled "backbone fwd" and "backbone rev" for each scaffold, were included at a final concentration of 20 nM each, and the amplification primers (T7 promoter and the unique spacer primer) were included at a final concentration of 1 µM each. The sg2, sg32, sg64, and sg174 guides correspond to SEQ ID NOS: 5, 2104, 2106, and 2238, respectively, with the exception that sg2, sg32, and sg64 were modified with an additional 5' G to increase transcription efficiency (compare sequences in Table 14 to Table 12). The 7.37 spacer targets beta2-microglobulin (B2M). Following PCR amplification, templates were cleaned and isolated by phenol-chloroform-isoamyl alcohol extraction followed by ethanol precipitation.

In vitro transcriptions were carried out in buffer containing 50 mM Tris pH 8.0, 30 mM $MgCl_2$, 0.01% Triton X-100, 2 mM spermidine, 20 mM DTT, 5 mM NTPs, 0.5 µM template, and 100 µg/mL T7 RNA polymerase. Reactions were incubated at 37° C. overnight. 20 units of DNase I (Promega #M6101)) were added per 1 mL of transcription volume and incubated for one hour. RNA products were purified via denaturing PAGE, ethanol precipitated, and resuspended in 1× phosphate buffered saline. To fold the sgRNAs, samples were heated to 70° C. for 5 min and then cooled to room temperature. The reactions were supplemented to 1 mM final $MgCl_2$ concentration, heated to 50° C. for 5 min and then cooled to room temperature. Final RNA guide products were stored at −80° C.

TABLE 14

Sequences for generation of guide RNA

| Primer | RNA product | SEQ ID NO |
|---|---|---|
| T7 promoter primer | Used for all | 951 |
| sg2 backbone fwd<br>sg2 backbone rev<br>sg2.7.37 spacer primer | GGUACUGGCGCUUUUAUCUCAUUACUUUGAGAGCCAUCACC<br>AGCGACUAUGUCGUAUGGGUAAAGCGCUUAUUUAUCGGAGA<br>GAAAUCCGAUAAAUAAGAAGCAUCAAAGGGCCGAGAUGUCU<br>CGCUCCG | 964 |
| sg32 backbone fwd<br>sg32 backbone rev<br>sg32.7.37 spacer primer | GGUACUGGCGCUUUUAUCUCAUUACUUUGAGAGCCAUCACC<br>AGCGACUAUGUCGUAUGGGUAAAGCGCCCUCUUCGGAGGGA<br>AGCAUCAAAGGGCCGAGAUGUCUCG | 965 |
| sg64 backbone fwd<br>sg64 backbone rev<br>sg64.7.37 spacer primer | GGUACUGGCGCCUUUAUCUCAUUACUUUGAGAGCCAUCACC<br>AGCGACUAUGUCGUAUGGGUAAAGCGCUUACGGACUUCGGU<br>CCGUAAGAAGCAUCAAAGGGCCGAGAUGUCUCGCUCCG | 966 |
| sg174 backbone fwd<br>sg174 backbone rev<br>sg174.7.37 spacer primer | ACUGGCGCUUUUAUCUgAUUACUUUGAGAGCCAUCACCAGC<br>GACUAUGUCGUAgUGGGUAAAGCUCCCUCUUCGGAGGGAGC<br>AUCAAAGGGCCGAGAUGUCUCGCUCCG | 967 |
| sg235 backbone fwd<br>sg235 backbone rev<br>sg235.7.37 spacer primer | ACUGGCGCUUCUAUCUGAUUACUCUGAGCGCCAUCACCAGC<br>GACUAUGUCGUAGUGGGUAAAGCCGCUUACGGACUUCGGUC<br>CGUAAGAGGCAUCAGAG | 35048 |

Example 4: CasX:gRNA In Vitro Cleavage Assays

1. Assembly of RNP

Purified wild-type and RNP of CasX and single guide RNA (sgRNA) were either prepared immediately before experiments or prepared and snap-frozen in liquid nitrogen and stored at −80° C. for later use. To prepare the RNP complexes, the CasX protein was incubated with sgRNA at 1:1.2 molar ratio. Briefly, sgRNA was added to Buffer #1 (25 mM NaPi, 150 mM NaCl, 200 mM trehalose, 1 mM MgCl2), then the CasX was added to the sgRNA solution, slowly with swirling, and incubated at 37° C. for 10 min to form RNP complexes. RNP complexes were filtered before use through a 0.22 μm Costar 8160 filters that were pre-wet with 200 μl Buffer #1. If needed, the RNP sample was concentrated with a 0.5 ml Ultra 100-Kd cutoff filter, (Millipore part #UFC510096), until the desired volume was obtained. Formation of competent RNP was assessed as described below.

2. In Vitro Cleavage Assays: Determining Cleavage-Competent Fractions for Protein Variants Compared to Wild-Type Reference CasX The ability of CasX variants to form active RNP compared to reference CasX was determined using an in vitro cleavage assay. The beta-2 microglobulin (B2M) 7.37 target for the cleavage assay was created as follows. DNA oligos with the sequence TGAAGCTGACAGCATTCGGGCCGAGATGTCTCGCTCCGTGGCCTTAGCTGTGCTCGCGC T (non-target strand, NTS (SEQ ID NO: 968)) and AGCGCGAGCACAGCTAAGGCCACGGAGCGAGA-CATCTCGGCCCGAATGCTGTCAGCTT CA (target strand, TS (SEQ ID NO: 969)) were purchased with 5' fluorescent labels (LI-COR IRDye 700 and 800, respectively). dsDNA targets were formed by mixing the oligos in a 1:1 ratio in 1× cleavage buffer (20 mM Tris HCl pH 7.5, 150 mM NaCl, 1 mM TCEP, 5% glycerol, 10 mM MgCl$_2$), heating to 95° C. for 10 minutes, and allowing the solution to cool to room temperature.

CasX RNPs were reconstituted with the indicated CasX and guides (see graphs) at a final concentration of 1 μM with 1.5-fold excess of the indicated guide unless otherwise specified in 1× cleavage buffer (20 mM Tris HCl pH 7.5, 150 mM NaCl, 1 mM TCEP, 5% glycerol, 10 mM MgCl$_2$) at 37° C. for 10 min before being moved to ice until ready to use. The 7.37 target was used, along with sgRNAs having spacers complementary to the 7.37 target.

Cleavage reactions were prepared with final RNP concentrations of 100 nM and a final target concentration of 100 nM. Reactions were carried out at 37° C. and initiated by the addition of the 7.37 target DNA. Aliquots were taken at 5, 10, 30, 60, and 120 minutes and quenched by adding to 95% formamide, 20 mM EDTA. Samples were denatured by heating at 95° C. for 10 minutes and run on a 10% urea-PAGE gel. The gels were either imaged with a LI-COR Odyssey CLx and quantified using the LI-COR Image Studio software or imaged with a Cytiva Typhoon and quantified using the Cytiva IQTL software. The resulting data were plotted and analyzed using Prism. We assumed that CasX acts essentially as a single-turnover enzyme under the assayed conditions, as indicated by the observation that sub-stoichiometric amounts of enzyme fail to cleave a greater-than-stoichiometric amount of target even under extended time-scales and instead approach a plateau that scales with the amount of enzyme present. Thus, the fraction of target cleaved over long time-scales by an equimolar amount of RNP is indicative of what fraction of the RNP is properly formed and active for cleavage. The cleavage traces were fit with a biphasic rate model, as the cleavage reaction clearly deviates from monophasic under this concentration regime, and the plateau was determined for each of three independent replicates. The mean and standard deviation were calculated to determine the active fraction (Table 15).

Figure 4:
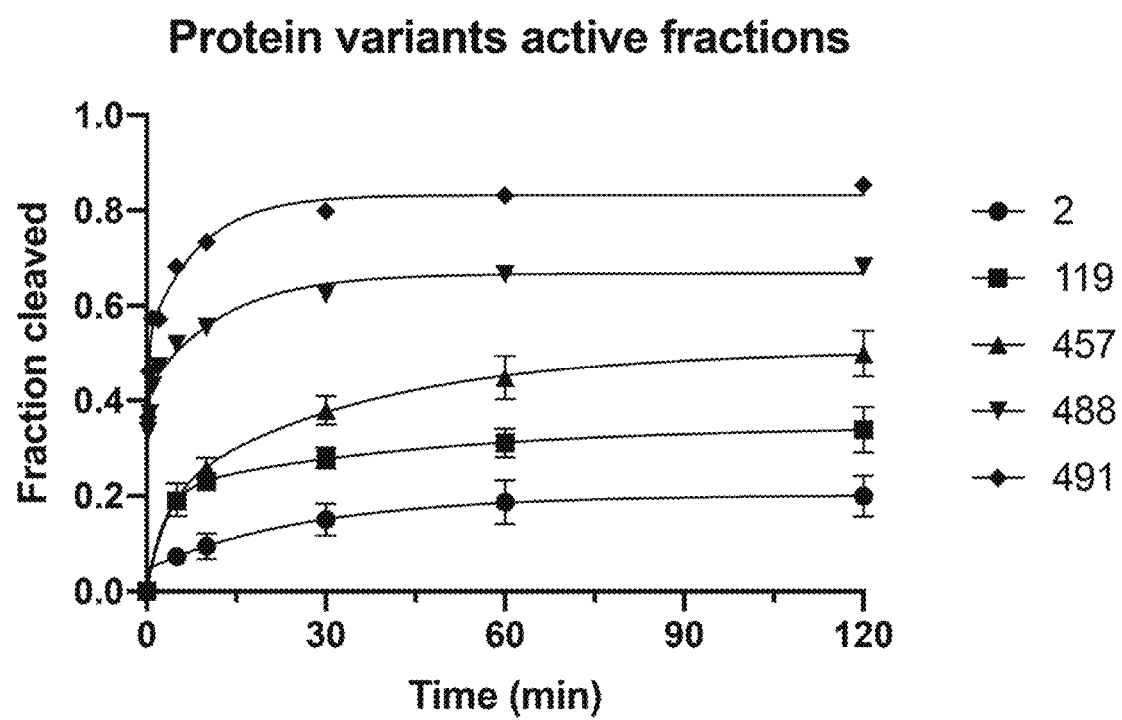
FIG. 4 is a graph of the results of an assay for the quantification of active fractions of RNP formed by sgRNA174 and the CasX variants, as described in Example 4. Equimolar amounts of RNP and target were co-incubated and the amount of cleaved target was determined at the indicated timepoints. Mean and standard deviation of three independent replicates are shown for each timepoint. The biphasic fit of the combined replicates is shown. "2" refers to the CasX protein of SEQ ID NO: 2.

Apparent active (competent) fractions were determined for RNPs formed for CasX2+ guide 174+7.37 spacer, CasX 119+ guide 174+7.37 spacer, CasX 457+ guide 174+7.37 spacer, CasX 488+ guide 174+7.37 spacer, and CasX 491+ guide 174+7.37 spacer, as shown in FIG. 4. The determined active fractions are shown in Table 15. All CasX variants had higher active fractions than the wild-type CasX2, indicating that the engineered CasX variants form significantly more active and stable RNP with the identical guide under tested conditions compared to wild-type CasX. This may be due to an increased affinity for the sgRNA, increased stability or solubility in the presence of sgRNA, or greater stability of a cleavage-competent conformation of the engineered CasX:sgRNA complex. An increase in solubility of the RNP was indicated by a notable decrease in the observed precipitate formed when CasX 457, CasX 488, or CasX 491 was added to the sgRNA compared to CasX2.

Figure 5:
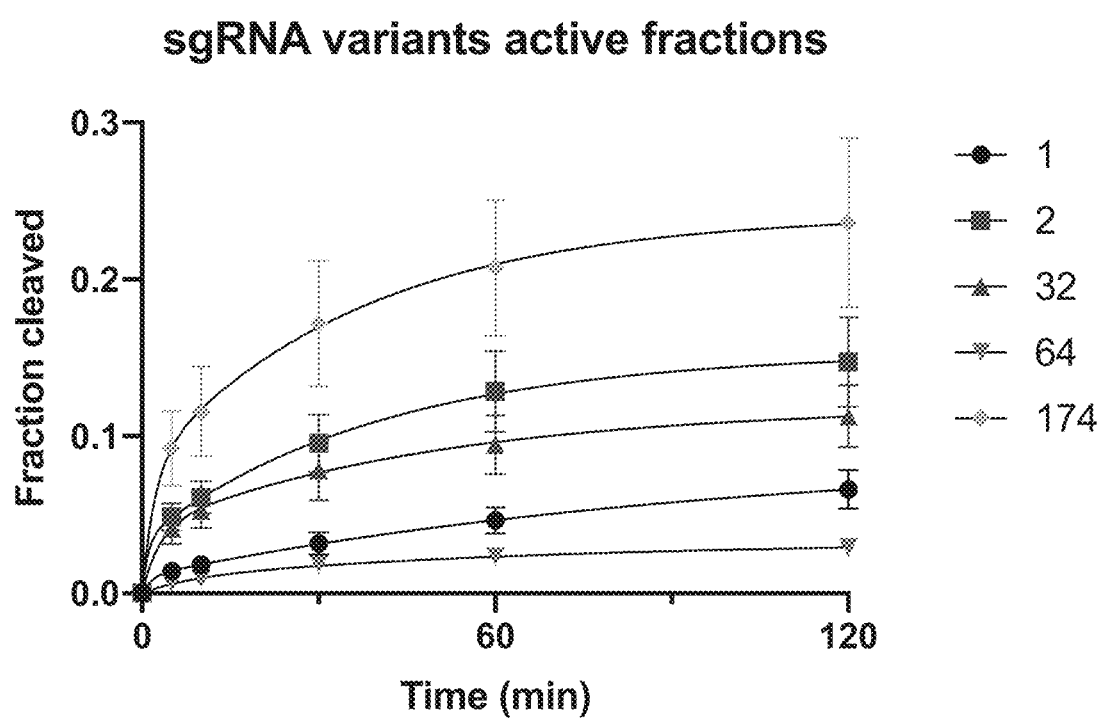
FIG. 5 shows the quantification of active fractions of RNP formed by CasX2 (reference CasX protein of SEQ ID NO: 2) and the reference and modified sgRNAs, as described in Example 4. Equimolar amounts of RNP and target were co-incubated and the amount of cleaved target was determined at the indicated timepoints. Mean and standard deviation of three independent replicates are shown for each timepoint. The biphasic fit of the combined replicates is shown.

3. In Vitro Cleavage Assays—Determining Cleavage-Competent Fractions for Single Guide Variants Relative to Reference Single Guides Cleavage-competent fractions were also determined using the same protocol for CasX2.2.7.37, CasX2.32.7.37, CasX2.64.7.37, and CasX2.174.7.37 to be 16±3%, 13±3%, 5±2%, and 22±5%, as shown in FIG. 5 and Table 15.

Figure 6:
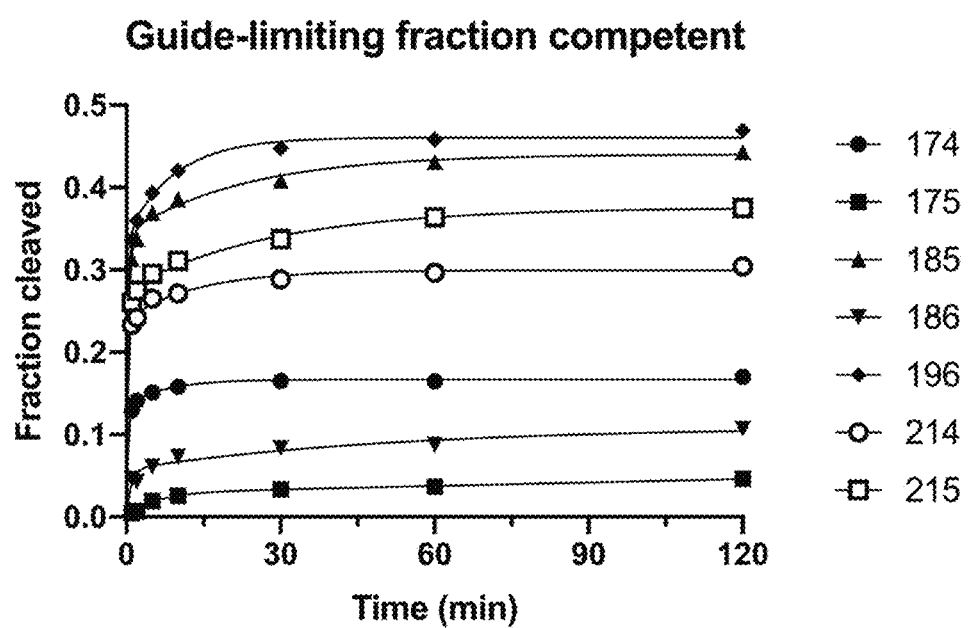
FIG. 6 shows the quantification of active fractions of RNP formed by CasX variant 491 and the modified sgRNAs under guide-limiting conditions, as described in Example 4. Equimolar amounts of RNP and target were co-incubated and the amount of cleaved target was determined at the indicated timepoints. The biphasic fit of the data is shown.

A second set of guides were tested under different conditions to better isolate the contribution of the guide to RNP formation. Guides 174, 175, 185, 186, 196, 214, and 215 with 7.37 spacer were mixed with CasX 491 at final concentrations of 1 µM for the guide and 1.5 µM for the protein, rather than with excess guide as before. Results are shown in FIG. 6 and Table 15. Many of these guides exhibited additional improvement over 174, with 185 and 196 achieving 91±4% and 91±1% competent fractions, respectively, compared with 80±9% for 174 under these guide-limiting conditions.

The data indicate that both CasX variants and sgRNA variants are able to form a higher degree of active RNP with guide RNA compared to wild-type CasX and wild-type sgRNA.

The apparent cleavage rates of CasX variants 119, 457, 488, and 491 compared to wild-type reference CasX were determined using an in vitro fluorescent assay for cleavage of the target 7.37.

4. In Vitro Cleavage Assays—Determining $k_{cleave}$ for CasX Variants Compared to Wild-Type Reference CasX CasX RNPs were reconstituted with the indicated CasX (see FIG. 7) at a final concentration of 1 µM with 1.5-fold excess of the indicated guide in 1× cleavage buffer (20 mM Tris HCl pH 7.5, 150 mM NaCl, 1 mM TCEP, 5% glycerol, 10 mM MgCl$_2$) at 37° C. for 10 min before being moved to ice until ready to use. Cleavage reactions were set up with a final RNP concentration of 200 nM and a final target concentration of 10 nM. Reactions were carried out at 37° C. except where otherwise noted and initiated by the addition of the target DNA. Aliquots were taken at 0.25, 0.5, 1, 2, 5, and 10 minutes and quenched by adding to 95% formamide, 20 mM EDTA. Samples were denatured by heating at 95° C. for 10 minutes and run on a 10% urea-PAGE gel. The gels were imaged with a LI-COR Odyssey CLx and quantified using the LI-COR Image Studio software or imaged with a Cytiva Typhoon and quantified using the Cytiva IQTL software. The resulting data were plotted and analyzed using Prism, and the apparent first-order rate constant of non-target strand cleavage ($k_{cleave}$) was determined for each CasX: sgRNA combination replicate individually. The mean and standard deviation of three replicates with independent fits are presented in Table 15, and the cleavage traces are shown in FIG. 8.

Figure 7:
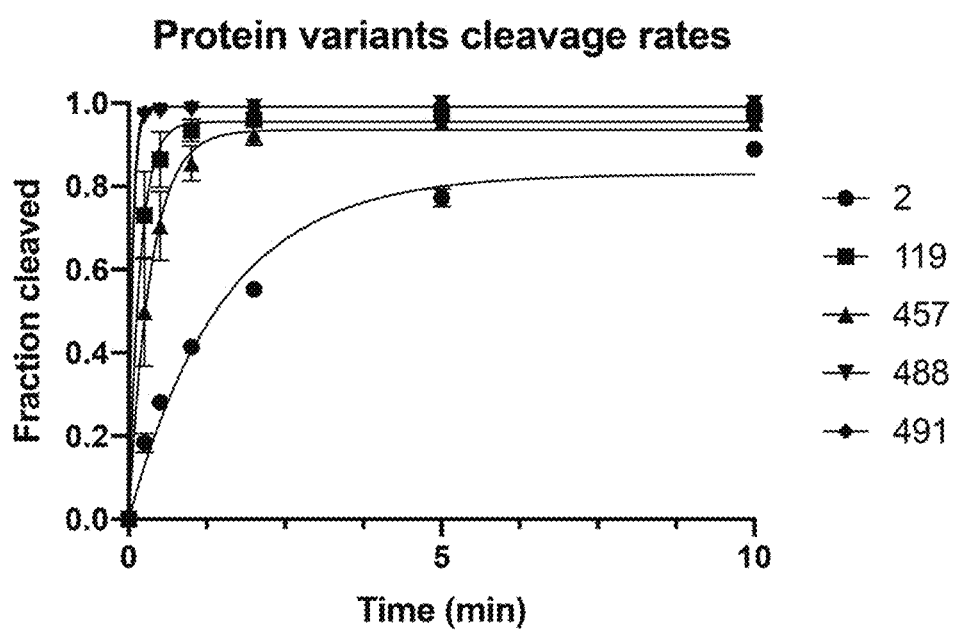
FIG. 7 shows the quantification of cleavage rates of RNP formed by sgRNA174 and the CasX variants, as described in Example 4. Target DNA was incubated with a 20-fold excess of the indicated RNP and the amount of cleaved target was determined at the indicated time points. Mean and standard deviation of three independent replicates are shown for each timepoint, except for 488 and 491 where a single replicate is shown. The monophasic fit of the combined replicates is shown.
Figure 8:
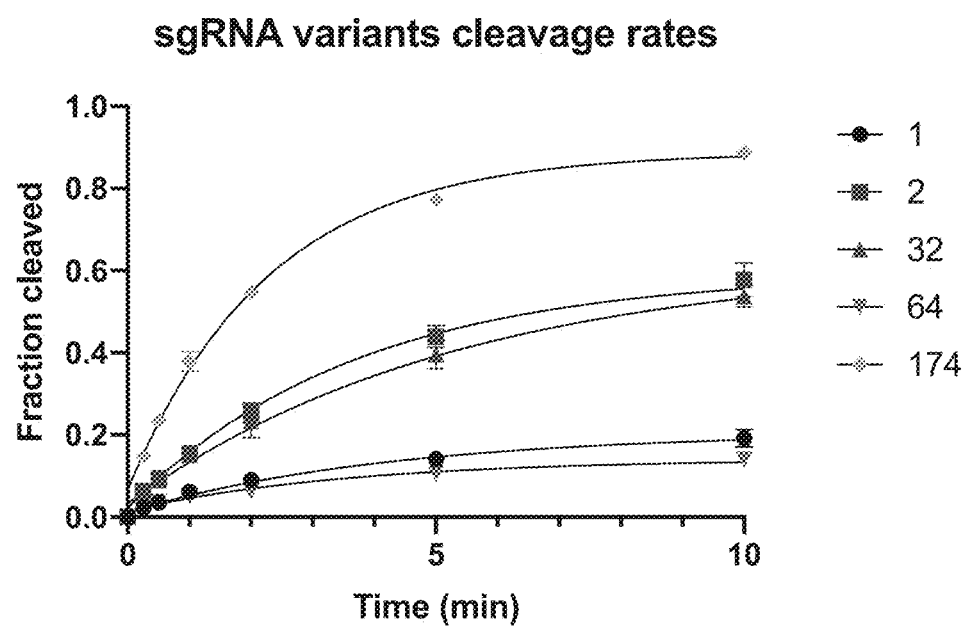
FIG. 8 shows the quantification of cleavage rates of RNP formed by CasX2 and the sgRNA variants, as described in Example 4. Target DNA was incubated with a 20-fold excess of the indicated RNP and the amount of cleaved target was determined at the indicated time points. Mean and standard deviation of three independent replicates are shown for each timepoint. The monophasic fit of the combined replicates is shown.

Apparent cleavage rate constants were determined for wild-type CasX2, and CasX variants 119, 457, 488, and 491 with guide 174 and spacer 7.37 utilized in each assay (see Table 15 and FIG. 7). All CasX variants had improved cleavage rates relative to the wild-type CasX2. CasX 457 cleaved more slowly than CasX 119, despite having a higher competent fraction as determined above. CasX 488 and CasX 491 had the highest cleavage rates by a large margin; as the target was almost entirely cleaved in the first timepoint, the true cleavage rate exceeds the resolution of this assay, and the reported $k_{cleave}$ should be taken as a lower bound.

The data indicate that the CasX variants have a higher level of activity, with $k_{cleave}$ rates reaching at least 30-fold higher compared to wild-type CasX2.

5. In Vitro Cleavage Assays: Determination of Cleavage Rates for Guide Variants Compared to Reference Single Guides.

Cleavage assays were also performed with wild-type reference CasX2 and reference guide 2 compared to gRNA variants 32, 64, and 174 (SEQ ID NOS: 5, 2104, 2106, and 2238, respectively) to determine whether the variants improved cleavage. The experiments were performed as described above. As many of the resulting RNPs did not approach full cleavage of the target in the time tested, we determined initial reaction velocities ($V_0$) rather than first-order rate constants. The first two timepoints (15 and 30 seconds) were fit with a line for each CasX:sgRNA combination and replicate. The mean and standard deviation of the slope for three replicates were determined.

Figure 9:
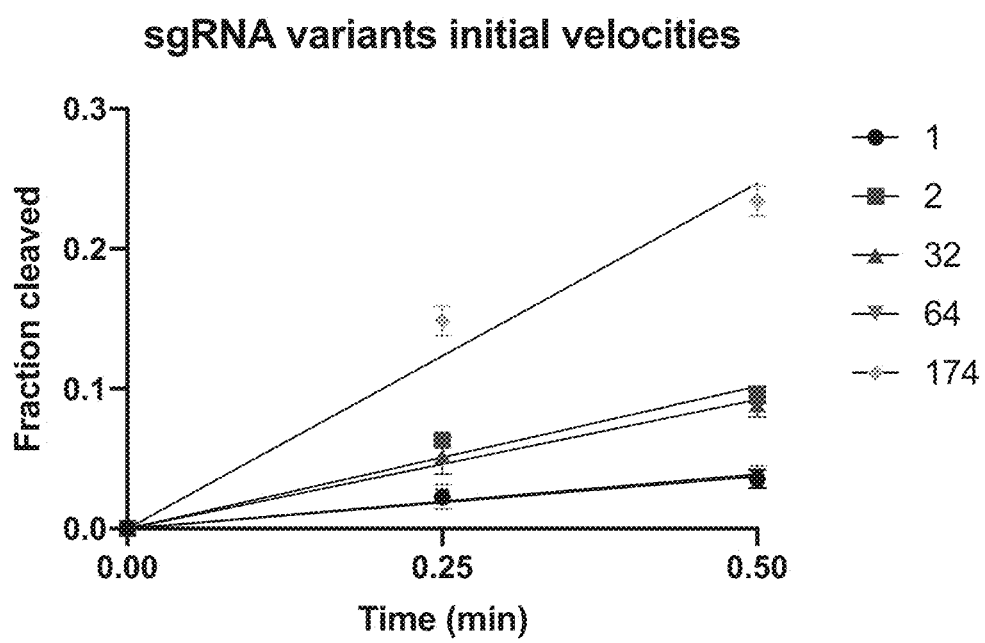
FIG. 9 shows the quantification of initial velocities of RNP formed by CasX2 and the sgRNA variants, as described in Example 4. The first two time-points of the previous cleavage experiment were fit with a linear model to determine the initial cleavage velocity.

Under the assayed conditions, the $V_0$ for CasX2 with guides 2, 32, 64, and 174 were 20.4±1.4 nM/min, 18.4±2.4 nM/min, 7.8±1.8 nM/min, and 49.3±1.4 nM/min (see Table 15 and FIG. 8 and FIG. 9). Guide 174 showed substantial improvement in the cleavage rate of the resulting RNP (~2.5-fold relative to 2, see FIG. 9), while guides 32 and 64 performed similar to or worse than guide 2. Notably, guide 64 supports a cleavage rate lower than that of guide 2 but performs much better in vivo (data not shown). Some of the sequence alterations to generate guide 64 likely improve in vivo transcription at the cost of a nucleotide involved in triplex formation. Improved expression of guide 64 likely explains its improved activity in vivo, while its reduced stability may lead to improper folding in vitro.

Additional experiments were carried out with guides 174, 175, 185, 186, 196, 214, and 215 with spacer 7.37 and CasX 491 to determine relative cleavage rates. To reduce cleavage kinetics to a range measurable with our assay, the cleavage reactions were incubated at 10° C. Results are in FIG. 10 and Table 15. Under these conditions, 215 was the only guide that supported a faster cleavage rate than 174. 196, which exhibited the highest active fraction of RNP under guide-limiting conditions, had kinetics essentially the same as 174, again highlighting that different variants result in improvements of distinct characteristics.

The data support that use of the majority of the guide variants with CasX results in RNP with a higher level of activity than one with the wild-type guide, with improvements in initial cleavage velocity ranging from ~2-fold to >6-fold. Numbers in Table 15 indicate, from left to right, CasX variant, sgRNA scaffold, and spacer sequence of the RNP construct. In the RNP construct names in the table below, CasX protein variant, guide scaffold and spacer are indicated from left to right.

6. In Vitro Cleavage Assays: Comparing Cleavage Rate and Competent Fraction of 515.174 and 526.174 Against Reference 2.2.

We wished to compare engineered protein CasX variants 515 and 526 in complex with engineered single-guide variant 174 against the reference wild-type protein 2 (SEQ ID NO: 2) and minimally-engineered guide variant 2 (SEQ ID NO: 5). RNP complexes were assembled as described above, with 1.5-fold excess guide. Cleavage assays to determine $k_{cleave}$ and competent fraction were performed as described above, with both performed at 37° C., and with different timepoints used to determine the competent fraction for the wild-type vs engineered RNPs due to the significantly different times needed for the reactions to near completion.

Figure 11:
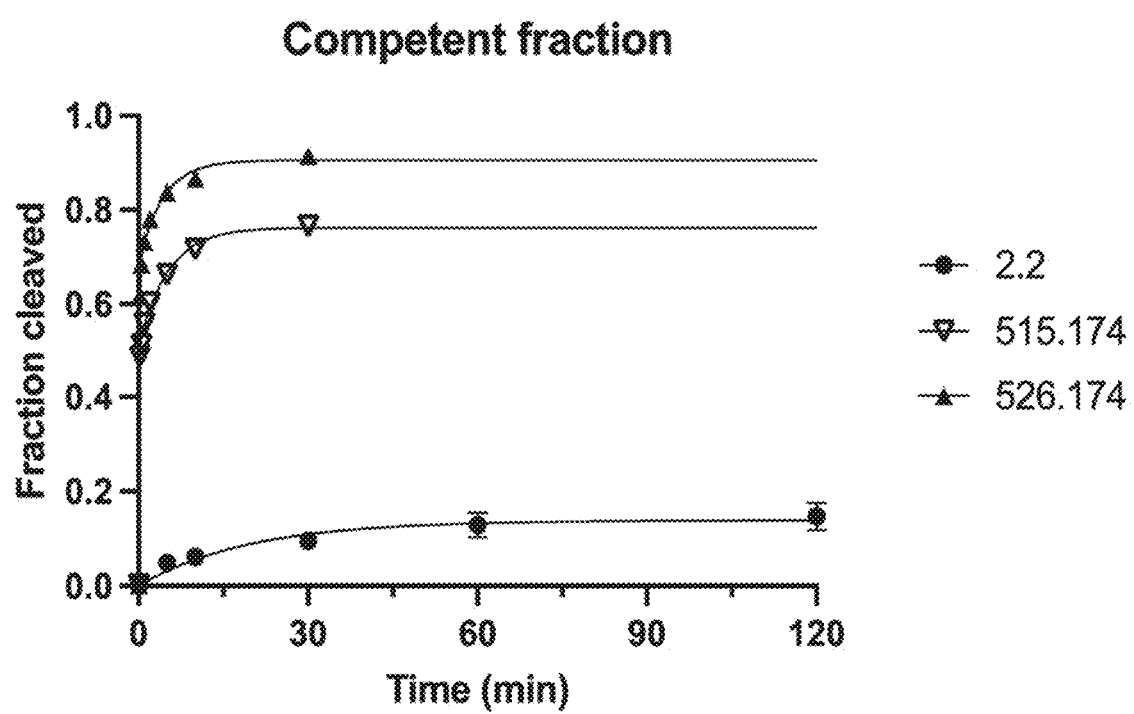
FIG. 11 shows the quantification of competent fractions of RNP of CasX variant 515 and 526 complexed with gRNA variant 174 compared to RNP of reference CasX 2 complexed with gRNA 2 using equimolar amounts of indicated RNP and a complementary target, as described in Example 4. The biphasic fit for each time course or set of combined replicates is shown.
Figure 12:
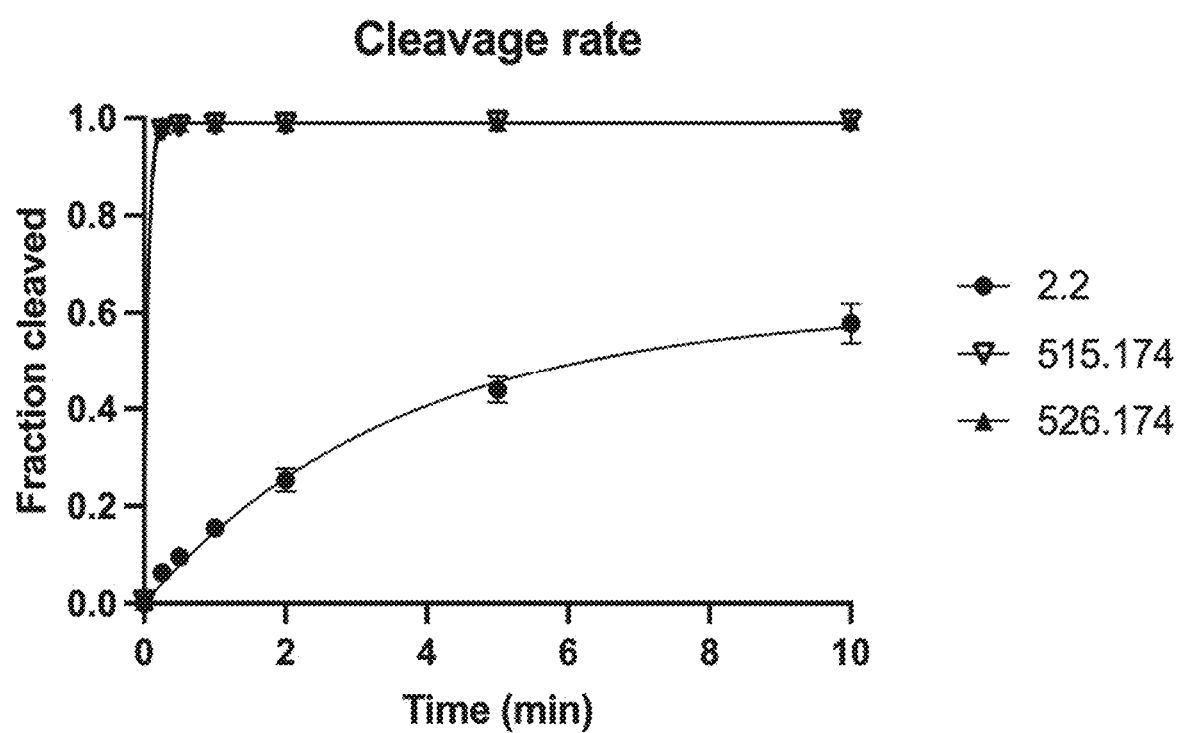
FIG. 12 shows the quantification of cleavage rates of RNP of CasX variant 515 and 526 complexed with gRNA variant 174 compared to RNP of reference CasX 2 complexed with gRNA 2 using with a 20-fold excess of the indicated RNP, as described in Example 4.

The resulting data clearly demonstrate the dramatic improvements made to RNP activity by engineering both protein and guide. RNPs of 515.174 and 526.174 had competent fractions of 76% and 91%, respectively, as compared to 16% for 2.2 (FIG. 11, Table 15). In the kinetic assay, both 515.174 and 526.174 cut essentially all of the target DNA by the first timepoint, exceeding the resolution of the assay and resulting in estimated cleavage rates of 17.10 and 19.87 min$^{-1}$, respectively (FIG. 12, Table 15). An RNP of 2.2, by contrast, cut on average less than 60% of the target DNA by the final 10-minute timepoint and has an estimated $k_{cleave}$ nearly two orders of magnitude lower than the engineered RNPs. The modifications made to the protein and guide have resulted in RNPs that are more stable, more likely to form active particles, and cut DNA much more efficiently on a per-particle basis as well. 6. In vitro cleavage assays: Comparing cleavage rate and competent fraction of 515.174 and 526.174 against reference 2.2.

The engineered protein CasX variants 515 and 526 were compared in complex with engineered single-guide variant 174 against the reference wild-type protein 2 (SEQ ID NO: 2) and minimally-engineered guide variant 2 (SEQ ID NO: 5). RNP complexes were assembled as described above, with 1.5-fold excess guide. Cleavage assays to determine $k_{cleave}$ and competent fraction were performed as described above, with both performed at 37° C., and with different timepoints used to determine the competent fraction for the wild-type vs engineered RNPs due to the significantly different times needed for the reactions to near completion.

The resulting data clearly demonstrate the dramatic improvements made to RNP activity by engineering both protein and guide. RNPs of 515.174 and 526.174 had competent fractions of 76% and 91%, respectively, as compared to 16% for 2.2 (FIG. 11, Table 15). In the kinetic assay, both 515.174 and 526.174 cut essentially all of the target DNA by the first timepoint, exceeding the resolution of the assay and resulting in estimated cleavage rates of 17.10 and 19.87 min$^{-1}$, respectively (FIG. 12, Table 15). An RNP of 2.2, by contrast, cut on average less than 60% of the target DNA by the final 10-minute timepoint and has an estimated $k_{cleave}$ nearly two orders of magnitude lower than the engineered RNPs. The modifications made to the protein and guide have resulted in RNPs that are more stable, more likely to form active particles, and cut DNA much more efficiently on a per-particle basis as well.

TABLE 15

Results of cleavage and RNP formation assays

| RNP Construct | Kcleave* | Initial velocity* | Competent fraction |
|---|---|---|---|
| 2.2.7.37 | | 20.4 ± 1.4 nM/min | 16 ± 3% |
| 2.32.7.37 | | 18.4 ± 2.4 nM/min | 13 ± 3% |
| 2.64.7.37 | | 7.8 ± 1.8 nM/min | 5 ± 2% |
| 2.174.7.37 | 0.51 ± 0.01 min$^{-1}$ | 49.3 ± 1.4 nM/min | 22 ± 5% |
| 119.174.7.37 | 6.29 ± 2.11 min$^{-1}$ | | 35 ± 6% |
| 457.174.7.37 | 3.01 ± 0.90 min$^{-1}$ | | 53 ± 7% |

TABLE 15-continued

Results of cleavage and RNP formation assays

| RNP Construct | Kcleave* | Initial velocity* | Competent fraction |
|---|---|---|---|
| 488.174.7.37 | 15.19 min$^{-1}$ | | 67% |
| 491.174.7.37 | 16.59 min$^{-1}$/0.293 min$^{-1}$ (10° C.) | | 83%/17% (guide-limited) |
| 491.175.7.37 | 0.089 min$^{-1}$ (10° C.) | | 5% (guide-limited) |
| 491.185.7.37 | 0.227 min$^{-1}$ (10° C.) | | 44% (guide-limited) |
| 491.186.7.37 | 0.099 min$^{-1}$ (10° C.) | | 11% (guide-limited) |
| 491.196.7.37 | 0.292 min$^{-1}$ (10° C.) | | 46% (guide-limited) |
| 491.214.7.37 | 0.284 min$^{-1}$ (10° C.) | | 30% (guide-limited) |
| 491.215.7.37 | 0.398 min$^{-1}$ (10° C.) | | 38% (guide-limited) |
| 515.174.7.37 | 17.10 min$^{-1}$** | | 76% |
| 526.174.7.37 | 19.87 min$^{-1}$** | | 91% |

*Mean and standard deviation
**Rate exceeds resolution of assay

Example 5: Construction of XDP with Incorporated Glycoproteins to Evaluate Tropism and Editing Capabilities Viral vectors including lentiviral and retroviral vectors are most often pseudotyped with the envelope protein of vesicular stomatitis virus (VSV-G); a glycoprotein that endows both a broad host cell range and high vector particle stability. Experiments were performed in which XDPs with incorporated RNP of CasX and gRNA specific for editing tdTomato in mouse neural progenitor cells (tdT NPCs) were created with varying concentrations of incorporated VSV-G to determine the corresponding effects on editing in tdT NPCs via the enhanced delivery of the editing moiety by the VSV-G.

Figure 13:
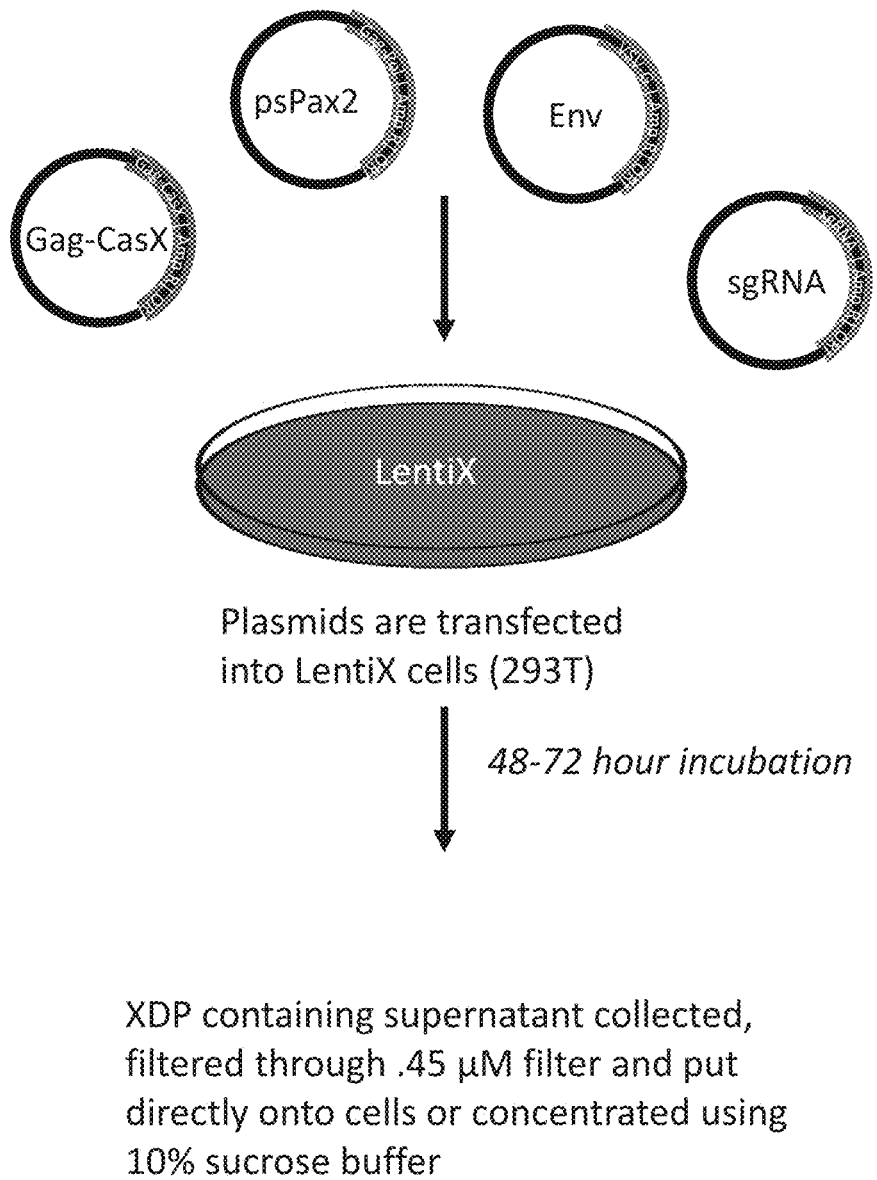
FIG. 13 is a schematic of the steps using in the creation of XDP, as described in Example 5.
Figure 14:
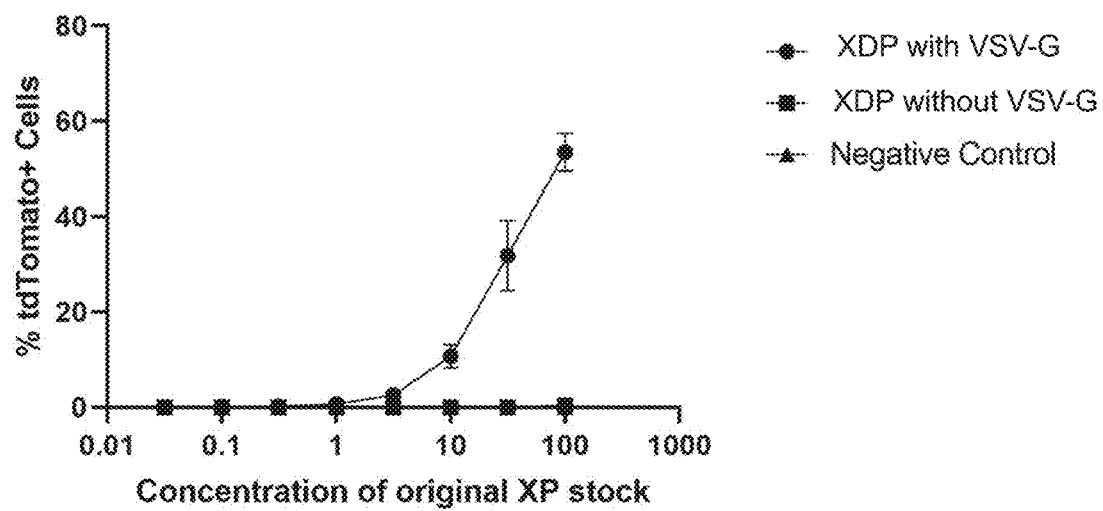
FIG. 14 is a graph of the results of the editing of the dtTomato assay, as described in Example 5.

Experiments shown in FIGS. 13-14 follow the XDP production methods described in Examples that follow (for the CasX 119 and single guide RNA 174 with spacer sequence 12.7 targeted to tdTomato (tdT)). Sequences are shown in Table 16. For the experiments resulting in the data in FIGS. 15 and 16, the effects of varying concentrations of the pseudotyping (VSV-G) plasmid incorporated into the XDP were evaluated as follows: 1 µg of the VSV-G plasmid was used for the 100% VSV-G group, 0.3 µg was used for the 30% VSV-G group, 0.1 µg was used for the 10% VSV-G group, 0.03 µg was used for the 3% VSV-G group, 0.01 µg was used for the 1% VSV-G group, and 0.003 µg was used for the 0.3% VSV-G group. Titering of the XDPs produced was done using the Takara p24 rapid titer kit. Editing was assessed in the tdTomato NPC cells.

As shown in FIG. 14, XDPs pseudotyped with VSV-G resulted in editing in the tdTomato NPCs, whereas XDPs without a glycoprotein did not.

Figure 15:
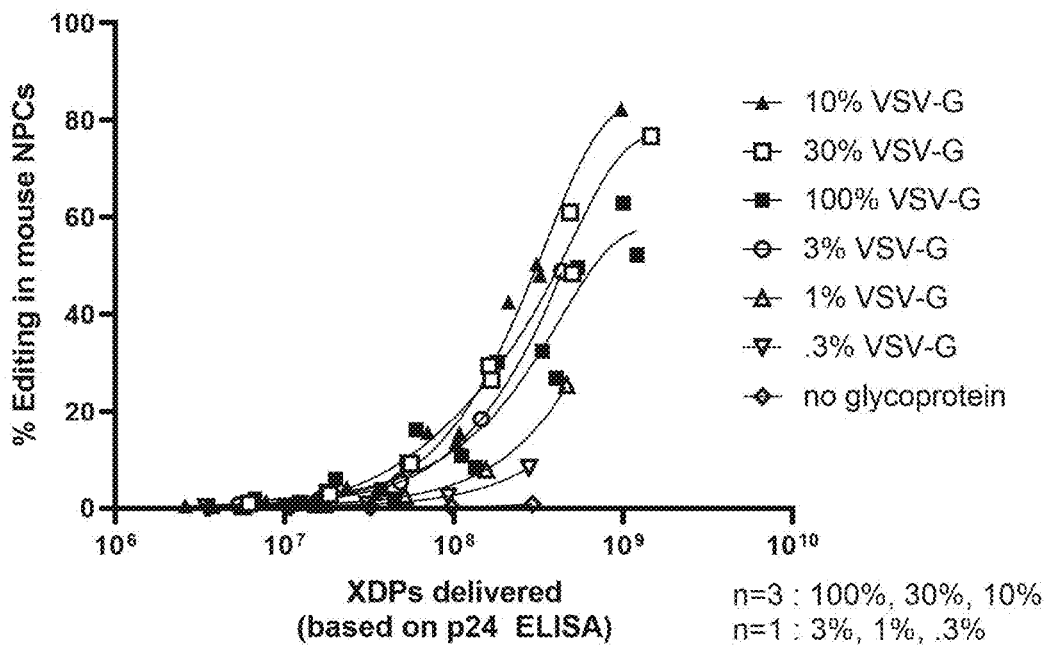
FIG. 15 shows the results of percentage editing in mouse tdTomato neural progenitor cells (NPCs) with XDPs pseudotyped with serial concentrations of VSV-G, as described in Example 5.
Figure 16:
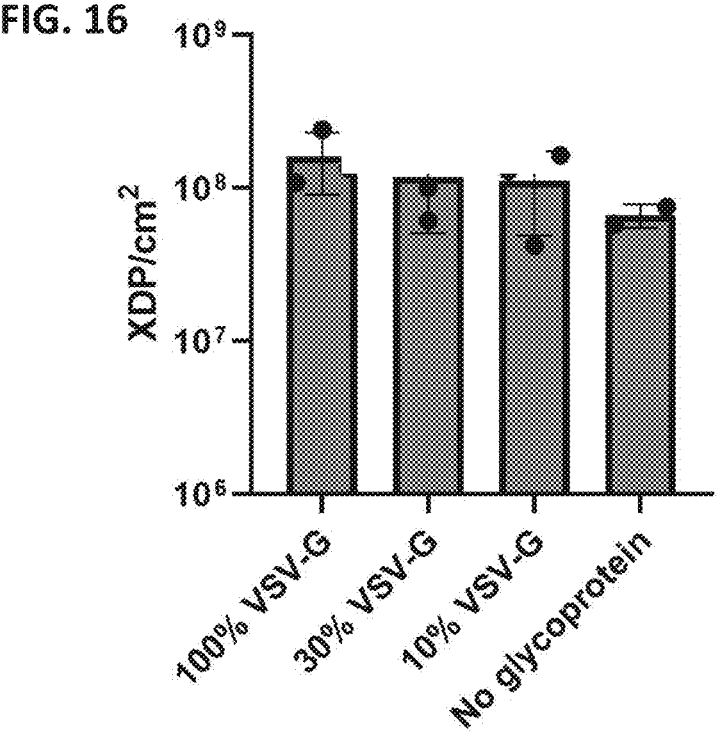
FIG. 16 shows the titers of XDPs produced using different percentages of VSV-G pseudotyped plasmids, as described in Example 5.

The results for the 10% and 30% VSV-G groups trend towards a better editing outcome as compared to the 100% VSV-G group, as shown in FIG. 15, without affecting viral titer or stability, as shown in FIG. 16.

As the results indicate that one can achieve the same, if not higher editing with 10-30% VSV-G compared to the 100% VSV-G group, which opens up the possibility of pseudotyping the XDP particle with other encoded glycoproteins, either with or without VSV-G, to confer differential or enhanced cellular tropism to the resulting XDP, including the viral glycoproteins disclosed herein, examples of which were produced and evaluated as follows. Each XDP transfection used 3.3 µg (0.467 pM) of psPax2 plasmid, 19.8 µg (3.24 pM) of pStx43.119 plasmid, 5 µg (3.13 pM) of pStx42 plasmid (with guide 174) targeting the tdTomato locus using spacer 12.7 and 0.262 pM of the respective glycoprotein(s)

plasmid which varied in molecular weight. Glycoprotein plasmids contained the same backbone pGP2 and only varied by expressing different viral envelope proteins which they expressed. The following plasmids were used for transfections: rabies used 0.94 µg of pGP29; FUG E used 0.95 µg of pGP60; HSV-1 used 0.28 µg of pGP14.1, 0.22 µg of pGP14.2, 0.27 µg of pGP14.3, and 0.20 µg of pGP14.4; RD114 used 0.96 µg of pGP8; HCV used 0.97 ug of pGP23; EBOV used 1.02 µg of pGP41; Mokola used 1.02 µg of pGP30. Canonical HSV-1 pseudotyping requires four glycoproteins which were used in equimolar amounts in this assay (Polpitiya Arachchige, S., Henke, W., Kalamvoki, M. et al. Analysis of herpes simplex type 1 gB, gD, and gH/gL on production of infectious HIV-1: HSV-1 gD restricts HIV-1 by exclusion of HIV-1 Env from maturing viral particles. Retrovirology 16:9 (2019)). Glycoprotein amino acid sequences come from wild type viral sequences. Nucleic acid sequences also came from wild type viral sequences though some were codon optimized for synthesis and expression in human cell lines.

The editing efficiencies in mouse tdTomato NPCs were tested with an initial panel of pseudotyped XDPs having glycoproteins from VSV-G, rabies, FUG E, HSV-1, RD114, hepatitis C virus (HCV), and Ebola virus (EBOV), produced as described above. While constructs with FUG E, Mokola and herpes simplex virus-1 (HSV-1) incorporated glycoproteins were expected to achieve some level of cell entry in NPCs, rabies was the only glycoprotein other than VSV-G resulting in an observable level of editing under the conditions of the assay, which is a readout for cell entry into mouse neural progenitor cells. Conversely, XDPs pseudotyped with HCV, EBOV and RD114 did not achieve any editing in mouse NPCs, which indicates the potential cell specificity requirements for this cell type.

Figure 17A:
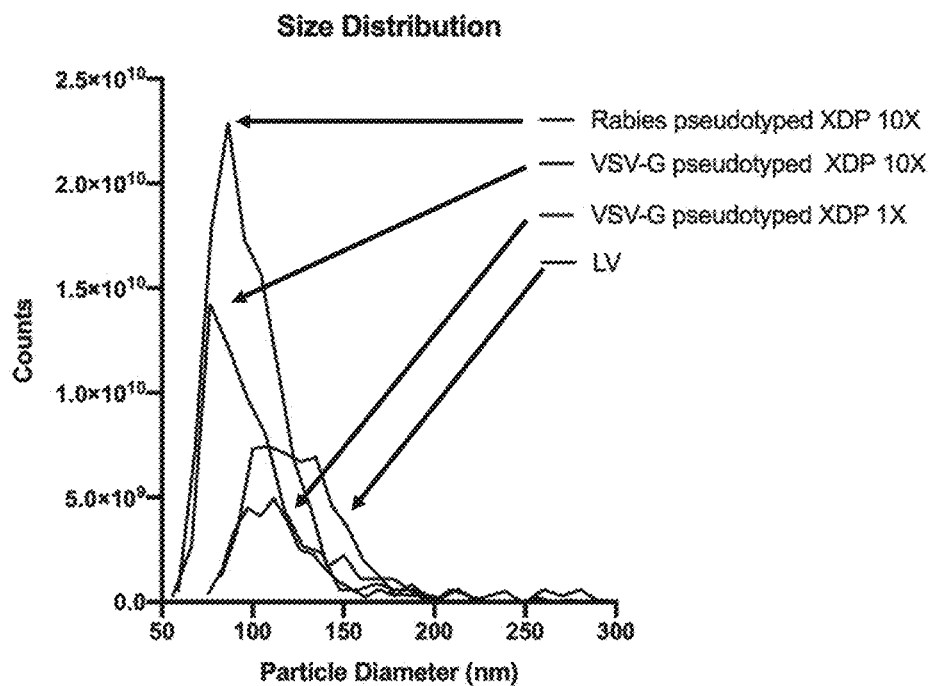
FIG. 17A shows the results of size distributions and viral titer comparisons of VSV-G pseudotyped XDP (both 1× and 10× concentrated), rabies pseudotyped XDP and lentivirus (LV), as described in Example 5.
Figure 17B:
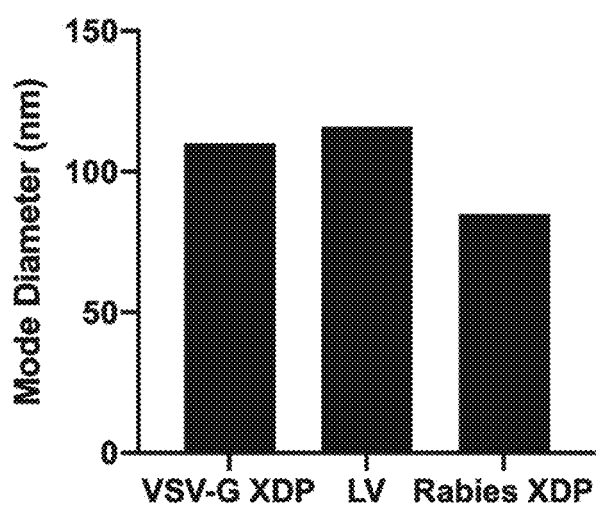
FIG. 17B shows the size comparisons between VSV-G XDP, LV and Rabies XDP, as described in Example 5.

We also assessed whether pseudotyping with different viral glycoproteins could have an impact on overall size distributions, which could have an impact on in vivo editing efficiencies in different tissues of interest. For this experiment, the rabies pseudotyped XDP 10× and VSV-G pseudotyped XDP 1× were produced using the protocol described above scaled to a 6 well format and using pGP29 in place of the pGP2 plasmid. All plasmid quantities and cells used were scaled down 8-fold. The VSV-G pseudotyped XDP 1× were generated as described above. These preparations were then concentrated at 20,000×g at 4° C. for 90 minutes without a sucrose buffer. LV was transfected with the following plasmid weights: 5.4 µg of psPax2, 1.8 µg of pGP2, and 7.2 µg of pStx34.119.174.12.7, generating lentivirus designed to induce production and incorporation of RNP with the same enzymatic capabilities as VSV-G pseudotyped XDP 1×. Samples were diluted appropriately for analysis. The size and number of particles were assessed using a Tunable Resistive Pulse Sensor (Izon Biosciences qNano Gold). While both rabies and VSV-G XDPs ranged in size from 75-140 nm, lentiviruses (LVs) tend to be a bit larger, ranging in size from 85-160 nm, as shown in FIG. 17A. FIG. 17B shows that rabies pseudotyped XDPs trend towards a smaller mode as compared to VSV-G pseudotyped XDPs.

TABLE 16

Plasmid encoding sequences for glycoproteins

| Glycoprotein | SEQ ID NO |
|---|---|
| pGP2 (VSV-G) | 1003 |
| pGP29 (Rabies) | 1004 |
| pGP60 (FUG E) | 1005 |

TABLE 16-continued

Plasmid encoding sequences for glycoproteins

| Glycoprotein | SEQ ID NO |
|---|---|
| pGP14.1 (HSV-1 gB) | 1006 |
| pGP14.2 (HSV-1 gD) | 1007 |
| pGP14.3 (HSV-1 gH) | 1008 |
| pGP14.4 (HSV-1 gL) | 1009 |
| pGP8 (RD 114) | 1010 |
| pGP23 (HCV) | 1011 |
| pGP41 (EBOV) | 1012 |
| pGP30 (Mokola) | 1013 |

Example 6: Construction and Evaluation of XDP with Non-Essential Lentiviral Components Removed The ability to improve XDP editing by optimizing RNP packaging into the viral vectors was evaluated by stripping away non-essential components such as the viral genome (Gag-Pol) from the Gag-CasX construct. Moreover, the removal of these components can alleviate some of the safety concerns with these platforms by taking away the reverse transcriptase (RT), integrase (IN) components that have been a source of concern for their use in humans.

The XDP were created using the same approach as described above (i.e., 8×10$^6$ LentiX cells were plated in a 10 cm dish, 24 hours later cells were transfected with DNA, media was changed 16 hours after transfection, XDPs were collected 72 hours post-transfection and concentrated). Here, we introduced a new plasmid having the components Gag, CasX, and protease, referred to as Gag-CasX-PR (or pMRG103; sequence in Table 17). This plasmid contains a Gag polyprotein followed by a CasX molecule linked by a SQNYPIVQ (SEQ ID NO: 20) HIV-1 cleavage site. The CasX molecule is followed by an HA tag and another SQNYPIVQ (SEQ ID NO: 20) HIV-1 cleavage site linked to a component of the Pol polyprotein from HIV-1. This plasmid encodes contains the HIV-1 protease (PR) and lacks the HIV-1 reverse transcriptase (RT), p15, and integrase (INT) components. Upon budding of the XDP from the cell membrane, the protease functions identically to the protease found in the native Gag-Pol complex; it dimerizes and facilitates cleavage of the SQNYPIVQ (SEQ ID NO: 20) HIV-1 cleavage sites, freeing CasX from Gag and PR. To generate XDPs with this new construct, the following plasmid amounts were used: 0.3 µg of pGP2, 5 µg of pStx42 (guide 174) with spacer 12.7, and 19.8 µg of pStx43.119 (CasX 119). Additional constructs used the following plasmid amounts: 100% Gag-Pol used 3.3 µg of psPax2; the 50% Gag-Pol+50% Gag-CasX construct used 1.65 µg of psPax2 and 1.48 µg of Gag-CasX-PR; the 30% Gag-Pol+ 70% Gag-CasX construct used 0.99 µg of psPax2 and 1.47 µg of Gag-CasX-PR; the 15% Gag-Pol+85% Gag-CasX construct used 0.50 µg of psPax2 and 2.51 µg of Gag-CasX-PR; and the 100% Gag-CasX construct used 3.00 µg of Gag-CasX-PR. Sequences are provided in Table 17.

Figure 18:
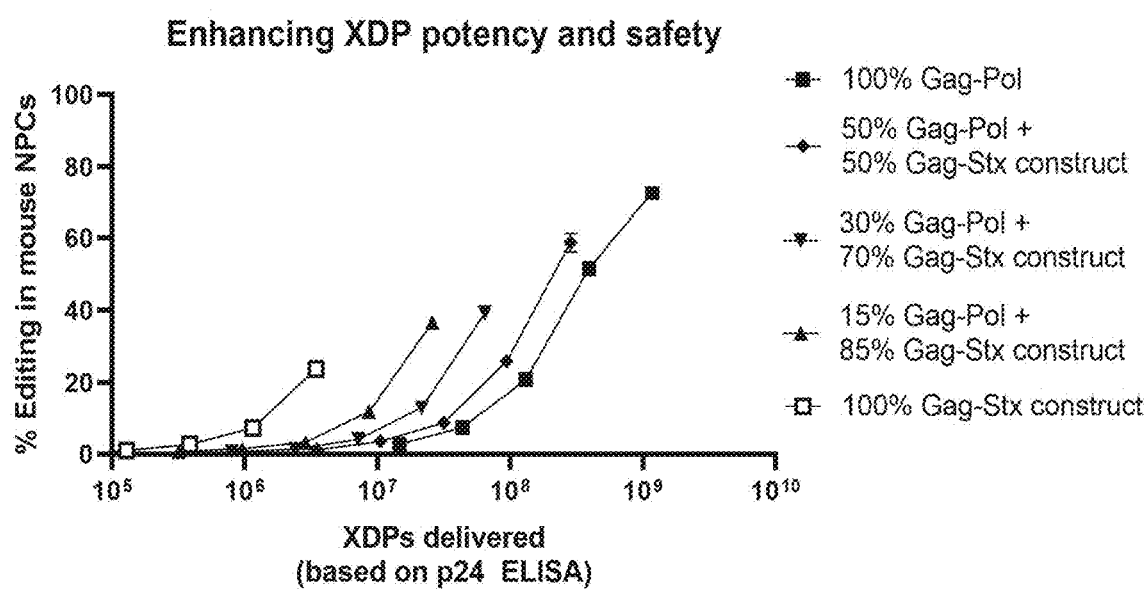
FIG. 18 shows the percentage editing in mouse tdTomato NPCs with VSV-G pseudotyped XDPs with titrated amounts of Gag-Pol vs Gag-Stx (Stx construct), as described in Example 6.
Figure 19:
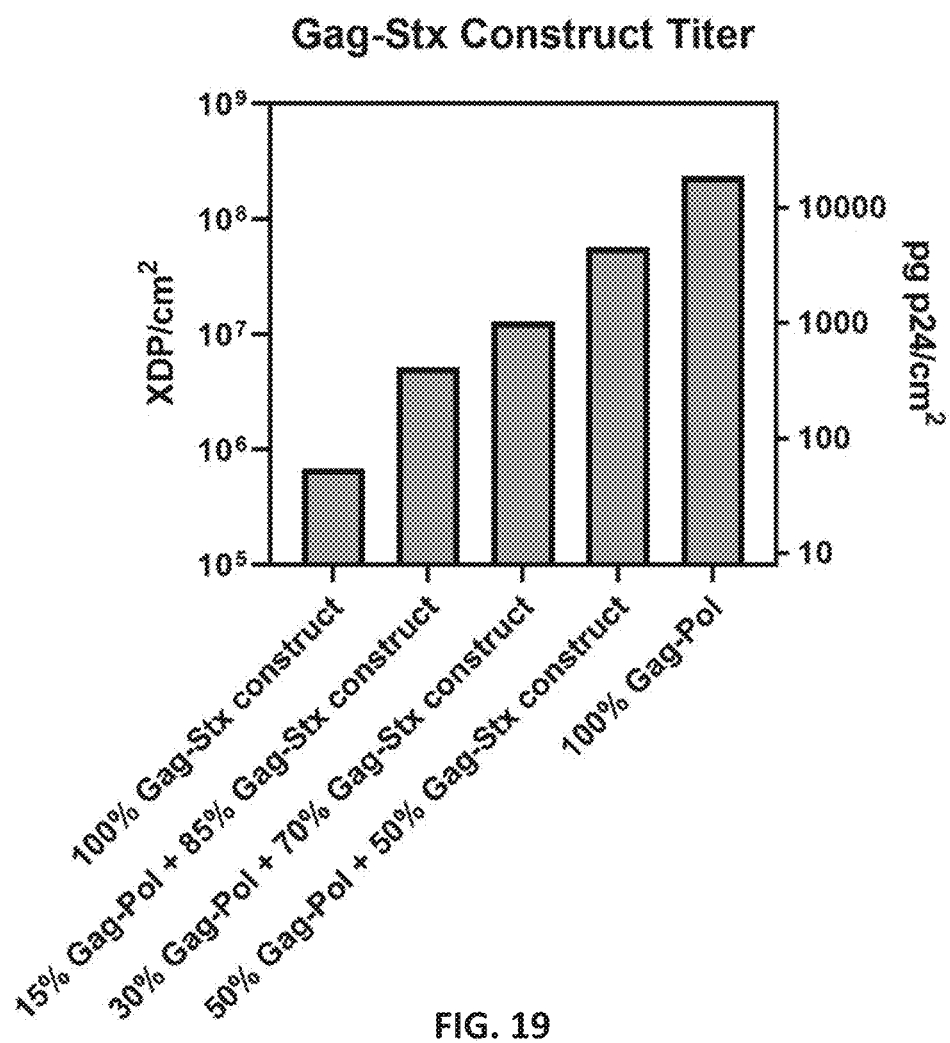
FIG. 19 shows the titers for different XDPs with varying amounts of Gag-Pol vs Gag-Stx constructs, as described in Example 6.
Figure 20:
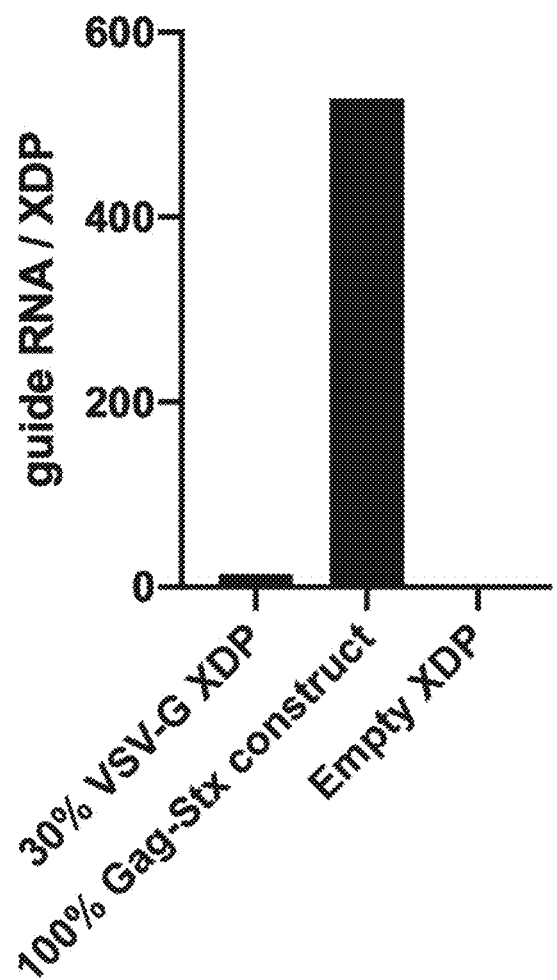
FIG. 20 shows the amount of guide RNA (gRNA) per XDP particle for different constructs as assessed by QPCR, as described in Example 6.

Editing of tdTomato NPCs was assessed as described above, and the titer of the XDP preparations was assessed using the Takara p24 Rapid Titer Kit. The results, shown in FIG. 18, demonstrated that XDP created with Gag-CasX-PR and no inclusion of Gag-Pol were able to achieve the same amount of editing at ~10$^6$ particles as compared to ~10$^8$ particles with XDPs that have 100% Gag-Pol. The other constructs showed editing in proportion to the titer of the particles. The titer data for the various constructs that were produced is shown in FIG. 19. We believe that this observed enhancement in editing efficiency is due to enhanced packaging of RNP molecules per XDP, as shown by guide RNA quantification for the different XDP constructs as depicted in FIG. 20.

TABLE 17

Plasmid encoding sequences

| Construct | SEQ ID NO |
|---|---|
| pMRG103 (Gag-CasX119-PR) | 1014 |
| pMRG103 (Gag-CasX438-PR) | 1015 |

Example 7: The Generation and Assessment of Potency of HIV-1 XDPs with Alternative Structures of HIV-1 Gag in Various Configurations The purpose of these experiments was to make various configurations of XDP constructs comprising CasX and guide RNA as RNP to demonstrate their utility in the editing of eukaryotic cells; either by in vitro or by in vivo delivery. To generate the most efficient and minimal HIV-1 capsid designed specifically for RNP delivery, we created thirty-five different versions of HIV-1 based XDPs with CasX 491 and guide RNA 174 and spacer 12.7 to tdTomato to 1) determine which components of HIV-1 were and were not necessary for the successful delivery of RNP to cells capable of editing target nucleic acid; and 2) demonstrate that multiple configurations of XDP were able to successfully delivery RNP to cells and edit target nucleic acid.

Methods

Method for the Generation of XDPs

Alternative configuration versions of the XDPs, referred to as versions 1, 4, 5, 7-27, 32-40, and 122-124, 126 and 128, were designed to contain RNP of CasX 491 complexed with a single guide RNA variant having spacer sequence 12.7 targeted to tdTomato (encoded by CTGCAT-TCTAGTTGTGGTTT, SEQ ID NO: 1018). Utilizing methods described in the sections below, the XDP versions were produced by transient transfection of LentiX HEK293T cells (Takara Biosciences) with one or more structural plasmids encoding components of the Gag-pol HIV-1 system, a plasmid encoding a pseudotyping glycoprotein, and a plasmid encoding a single guide RNA, grouped by version number, lists the plasmids and their sequences that were used to produce each version of the XDP containing the components indicated in Table 20 and the corresponding version of the Figures. For the plasmid encoding the guide RNA, the pStx42 plasmid was created with a human U6 promoter upstream of a guide RNA cassette having scaffold and spacer components targeted to tdTomato in a single-guide format (p42.174.12.7). Another pStx42 plasmid was utilized to make a guide RNA cassette having scaffold and non-targeting spacer components (Stx42.174.NT), used as a control in the editing assays. A plasmid encoding VSV-G (pGP2) for pseudotyping the XDP was also used (Table 19). All plasmids contained either an ampicillin or kanamycin resistance gene.

Structural Plasmid Cloning

In order to generate pXDP3, pXDP17, pXDP23-32, pXDP98-100, pXDP102 and pXDP103, pXDP1 was digested using EcoRI to remove the Gag-pol sequence. Between one and three fragments containing CasX and HIV-1 components were amplified using In Fusion primers with 15-20 base pair overlaps and Kapa HiFi DNA polymerase according to the manufacturer's protocols. The fragments were purified by gel extraction from a 1% agarose gel using Zymoclean Gel DNA Recovery Kit according to the manufacturer's protocol. These fragments were cloned into plasmid backbones using In-Fusion HD Cloning Kit from Takara (Cat #639650) according to the manufacturer's protocols. Assembled products were transformed into chemically-competent Turbo Competent E. coli bacterial cells, plated on LB-Agar plates (LB: Teknova Cat #L9315, Agar: Quartzy Cat #214510) containing ampicillin and incubated at 37° C. Individual colonies were picked and miniprepped using Qiagen spin Miniprep Kit following the manufacturer's protocol. The resultant plasmids were sequenced using Sanger sequencing to ensure correct assembly. The encoding sequences are presented in Table 20 (the first and second columns of the table describes the version number and CasX molecule included. The third is the configuration of the HIV components and CasX molecules. The plasmid number for those design plasmids are in the fourth column, and the corresponding SEQ ID NO is in the fifth column. The fourth column contains only the encoding sequences for HIV-1 gag, HIV-1 pol, and CasX molecules, as applicable).

Guide Plasmid Cloning

The p42.174.NT (NT sequence CGAGACGTAAT-TACGTCTCG, SEQ ID NO: 1019) plasmid encoding the guide RNA 174 and the non-targeting spacer and the p42.174.12.7 targeting tdTomato were cloned using standard cloning methods. The mammalian expression backbone contained a cPPT, ampicillin resistance, and a colEI replication site and was amplified using primers with appropriate overlaps to accept the U6 promoter and guide RNA scaffold cassette. These fragments were amplified and cloned as described for the structural plasmids, above. The resultant plasmids were sequenced using Sanger sequencing to ensure correct assembly.

Cloning tdTomato Spacer 12.7 into p42.174.NT

The targeting spacer sequence DNA for the tdTomato targeting spacer 12.7 was ordered as single-stranded DNA (ssDNA) oligos (Integrated DNA Technologies) consisting of the targeting sequence (CTGCATTCTAGTTGTGGTTT, SEQ ID NO: 1018) and the reverse complement of this sequence. These two oligos were annealed together and cloned into p42.174 NT or a p42 plasmids with an alternate scaffold. This was done by Golden Gate assembly using T4 DNA Ligase (New England BioLabs Cat #M0202L) and Esp3I restriction enzyme from NEB (New England BioLabs Cat #R0734L). Golden Gate products were transformed into chemically competent NEB Turbo competent E. coli (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen spin Miniprep Kit following the manufacturer's protocol. The resultant plasmids were sequenced using Sanger sequencing to ensure correct ligation.

pGP2 Glycoprotein Plasmid Cloning

Sequences encoding the VSV-G glycoprotein and the CMV promoter were amplified from pMD2.G (UC Berkeley) and cloned as described for the structural plasmids, above. The backbone was taken from a kanamycin resistant plasmid and amplified and cloned using the same methods. Assembled products were transformed into chemically-competent Turbo Competent E. coli bacterial cells, plated on LB-Agar plates containing kanamycin and incubated at 37° C. The resultant plasmids were sequenced using Sanger sequencing to ensure correct assembly.

Cell Culture and Transfection

HEK293T Lenti-X cells were maintained in 10% FBS supplemented DMEM with HEPES and Glutamax (Thermo Fisher). Cells were seeded in 15 cm dishes at 20×10$^6$ cells per dish in 20 mL of media. Cells were allowed to settle and grow for 24 hours before transfection. At the time of transfection, cells were 70-90% confluent. For transfection, the XDP structural plasmids (also encoding the CasX variants) of Table 18 were used in amounts ranging from 13 to 80.0 µg. Each transfection also received 13 µg of p42.174.12.7 and 0.25 µg of pGP2. Polyethylenimine (PEI Max, Polyplus) was then added to the plasmid mixture, mixed, and allowed to incubate at room temperature before being added to the cell culture.

Collection and Concentration

Figure 21:
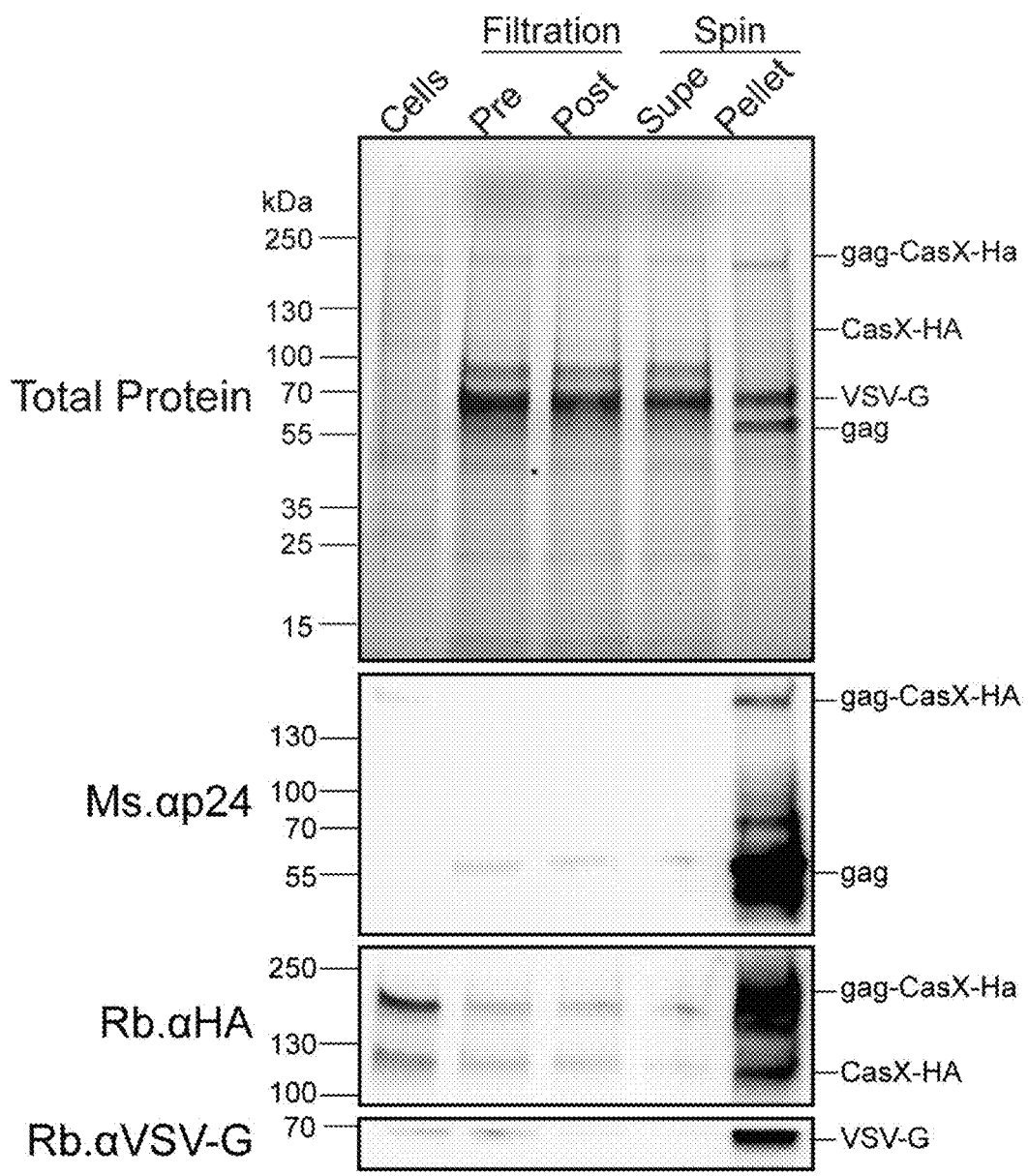
FIG. 21 shows representative SDS-PAGE and Western blot images of samples taken from throughout the centrifugation purification process for XDP particles, as described in Example 7.

Media was aspirated from the plates 24 hours post-transfection and replaced with Opti-MEM (Thermo Fisher). XDP-containing media was collected 72 hours post-transfection and filtered through a 0.45 µm PES filter. The supernatant was concentrated and purified via centrifugation at 10,000×g at 4° C. for 4h using a 10% sucrose buffer in NTE (50 mM Tris-HCL, 100 mM NaCl, 10% Sucrose, pH 7.4). XDPs were resuspended in 300 µL of DMEM/F12 supplemented with glutamax, HEPES, non-essential amino acids, Pen/Strep, 2-mercaptoethanol, B-27 without vitamin A, and N2. FIG. 21 shows representative SDS-PAGE and Western blot images of samples taken during the purification process.

Resuspension and Transduction tdTomato neural progenitor cells (tdT NPCs) were grown in DMEM/F12 supplemented with glutamax, HEPES, non-essential amino acids, Pen/Strep, 2-mercaptoethanol, B-27 without vitamin A, and N2. Cells were harvested using StemPro Accutase Cell Dissociation Reagent and seeded on PLF coated 96 well plates. Cells were allowed to grow for 48 hours before being treated for targeting XDPs (having a spacer for tdTomato) starting with neat resuspended virus and proceeding through 5 half-log dilutions. Cells were then centrifuged for 15 minutes at 1000×g. NPCs were grown for 96 hours before analysis of fluorescence as a marker of editing of tdTomato, as measured by flow cytometry. The assays were run 2-3 times for each sample with similar results. Editing results for a single assay are shown in Table 18.

Results

Figure 22:
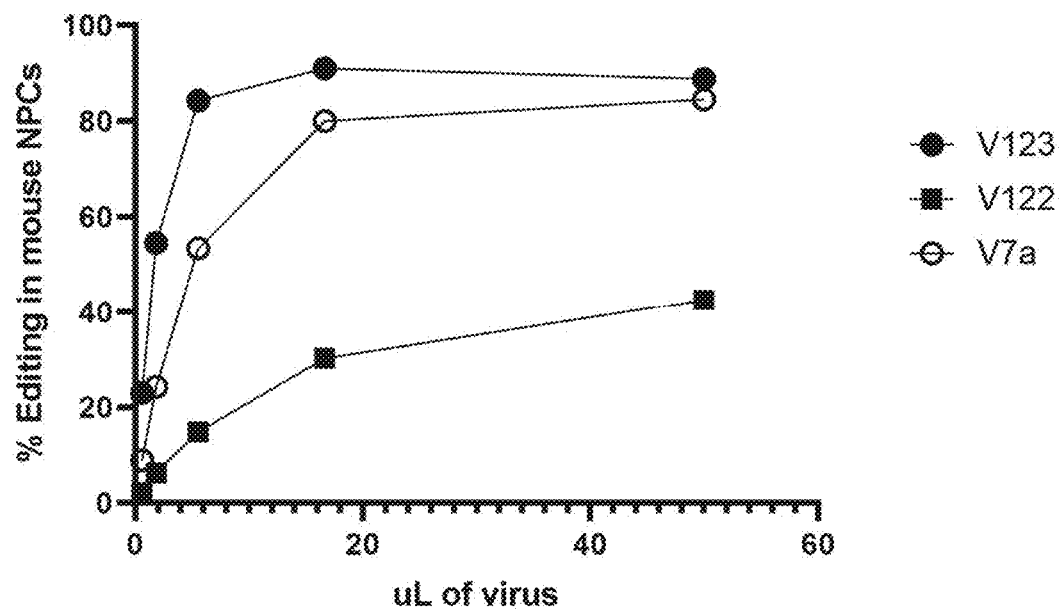
FIG. 22 shows the results of an editing assay for XDP configured as version 7, version 122 and version 123, as described in Example 7.

The editing results confirmed that the majority of the 35 alternative configurations were able to edit the NPCs with at least 10% or greater editing, with 7 versions showing >80% editing. Additionally, it was confirmed that some of the HIV structural components of Gag were dispensable, with editing seen in one configuration in which only the matrix (MA) component was linked to the CasX. The p1 and p6 components, which promotes budding from the host cell, was associated in all versions with high levels of editing (>=70%, V1, V7, V8, V33, V34, V40, V123, V124) suggesting that this component is important for potency. Particles without NC, such as versions 34, 40 and 123, were able to achieve high levels of editing whereas particles without CA (such as version 17) had lower levels of editing (37%). Furthermore, p2, a component of NC, was also detrimental to potency as seen when comparing versions 122 and 128 on Table 18 where 122 (MA-CA-p1/p6) has no p2 and achieves 44.4% editing and versions 128 (MA-CA-p2-p1-p6) includes p2 and archives only 29.2% editing. In addition, constructs with multiple p1 and p6 may contribute to enhance editing, as seen in FIG. 22, however, this did not prove to be the case for other configurations; e.g., version 7 (MA-CA-NC-p1-p6-CasX) versus version 124 (MA-CA-NC-p1-p6-p1-p6), where version 7 achieved 92.2% editing and version 124 achieved only 72.3% editing.

Overall, the results support that, under the conditions of the assays, multiple configurations of XDP are able to successfully assemble particles able to deliver the CasX and guide RNA therapeutic payloads to eukaryotic cells, resulting in editing of the target nucleic acid.

TABLE 18

Editing of NPCs by XDP constructs, by version configuration

| XDP Version | Structural Plasmid 1 | Structural Plasmid 2 | Structural Plasmid 1-Plasmid number | Structural plasmid 2-Plasmid number | CasX | % Editing |
|---|---|---|---|---|---|---|
| 1 | Gag-CasX gag(-1) | Gag-pol | pXDP17 | pXDP1 | 491 | 95.4 |
| 4 | gag(-1)-PR-CasX | | pXDP88 | | 491 | 2.78 |
| 7 | Gag-CasX | | pXDP17 | | 491 | 92.2 |
| 8 | Gag-CasX | gag | pXDP17 | pXDP3 | 491 | 87.5 |
| 9 | Ma-CA-NC-CasX | | pXDP23 | | 491 | 14.20 |
| 10 | MA-CA-NC-P1-CasX | | pXDP24 | | 491 | 7.19 |
| 11 | MA-CA-NC-CasX(-1)-Pro | | pXDP25 | | 491 | 35.8 |
| 12 | MA-CA-CasX(-1)-Pro | | pXDP26 | | 491 | 28.5 |
| 13 | MA-CasX-NC-(-1)-PR | | pXDP27 | | 491 | 17.3 |
| 14 | MA-CasX-(-1)-Pro | | pXDP28 | | 491 | 32.6 |
| 15 | MA-CasX-Pro | | pXDP29 | | 491 | 0 |
| 16 | MA-CA-CasX-Pro | | pXDP30 | | 491 | 1.86 |
| 17 | MA-CasX | | pXDP31 | | 491 | 37.9 |
| 18 | MA-CA-CasX | | pXDP32 | | 491 | 18.3 |
| 31 | MA-CA-NC-CasX | Gag | pXDP23 | pXDP3 | 491 | 17.0 |
| 32 | MA-CA-NC-P1-CasX | Gag | pXDP24 | pXDP3 | 491 | 13.40 |
| 33 | MA-CA-NC-X(-1)-PR | Gag | pXDP25 | pXDP3 | 491 | 90.1 |
| 34 | MA-CA-CasX(-1)-PR | Gag | pXDP26 | pXDP3 | 491 | 95.3 |
| 35 | MA-CasX-NC-p1-p6-(-1)-Pro | Gag | pXDP27 | pXDP3 | 491 | 11.6 |
| 36 | MA-CasX-(-1)-Pro | Gag | pXDP28 | pXDP3 | 491 | 25.10 |
| 38 | MA-CA-CasX-Pro | Gag | pXDP30 | pXDP3 | 491 | 8.5 |
| 39 | MA-CasX | Gag | pXDP31 | pXDP3 | 491 | 30.7 |
| 40 | MA-CA-CasX | Gag | pXDP32 | pXDP3 | 491 | 84.3 |
| 122 | MA-CA-p1-p6-CasX | | pXDP98 | | 491 | 44.4 |
| 123 | MA-CA-p1-p6-p1/p6-CasX | | pXDP99 | | 491 | 91.5 |
| 124 | MA-CA-NC-p1-p6-p1-p6-CasX | | pXDP100 | | 491 | 73.2 |
| 126 | MA-CA-NC-CasX-p1/p6 | | pXDP102 | | 491 | 44.8 |
| 128 | MA-CA-p2-p1-p6-CasX | | pXDP104 | | 491 | 29.2 |

*% Editing was calculated by taking the maximum editing percentage of the 5 dilutions' averaged replicates.

TABLE 19

Encoding sequences for guides and glycoproteins

| Plasmid number | DNA sequence |
|---|---|
| p42.174.12.7 | ACTGGCGCTTTTATCTgATTAC TTTGAGAGCCATCACCAGCGAC TATGTCGTAgTGGGTAAAGCTC CCTCTTCGGAGGGAGCATCAAA GCTGCATTCTAGTTGTGGTTT (SEQ ID NO: 1020) |

TABLE 19-continued

Encoding sequences for guides and glycoproteins

| Plasmid number | DNA sequence |
|---|---|
| p42.174.NT | ACTGGCGCTTTTATCTgATTAC TTTGAGAGCCATCACCAGCGAC TATGTCGTAgTGGGTAAAGCTC CCTCTTCGGAGGGAGCATCAAA GCGAGACGTAATTACGTCTCG (SEQ ID NO: 1021) |
| pGP2 | SEQ ID NO: 1003 |

TABLE 20

XDP Versions and Component Encoding Sequences

| XDP Version | CasX | Design | Plasmid number | DNA Sequence (SEQ ID NO) |
|---|---|---|---|---|
| 1 | 491 | MA-CA-NC-P1-P6-X | pXDPl7 | 1022 |
|  |  | MA-CA-NC-P1-P6-(-1)-POL | pXDPl | 1023 |
| 4 | 491 | MA-CA-NC-P1-P6-(-1)-X-PR | pXDP88 | 1024 |
| 5 | 491 | MA-CA-NC-P1-P6-X-PR | pXDP22 | 1025 |
| 7 | 491 | MA-CA-NC-P1-P6-X | pXDPl7 | 1022 |
| 8 | 491 | MA-CA-NC-P1-P6-X | pXDPl7 | 1022 |
|  |  | MA-CA-NC-P1-P6 | pXDP3 | 1026 |
| 9 | 491 | MA-CA-NC-X(no p1-p6) | pXDP23 | 1027 |
| 10 | 491 | MA-CA-NC-P1-X | pXDP24 | 1028 |
| 11 | 491 | MA-CA-NC-X-(-1)-PR | pXDP25 | 1029 |
| 12 | 491 | MA-CA-X-(-1)-PR | pXDP26 | 1030 |
| 13 | 491 | MA-X-NC-(-1)-PR | pXDP27 | 1031 |
| 14 | 491 | MA-X-(-1)-PR | pXDP28 | 1032 |
| 15 | 491 | MA-X-PR | pXDP29 | 1033 |
| 16 | 491 | MA-CA-X-PR | pXDP30 | 1034 |
| 17 | 491 | MA-X | pXDP31 | 1035 |
| 18 | 491 | MA-CA-X | pXDP32 | 1036 |
| 31 | 491 | MA-CA-NC-X | pXDP23 | 1027 |
|  |  | MA-CA-NC-P1-P6 | pXDP3 | 1026 |
| 32 | 491 | MA-CA-NC-P1-X | pXDP24 | 1037 |
|  |  | MA-CA-NC-P1-P6 | pXDP3 | 1026 |
| 33 | 491 | MA-CA-NC-X-(-1)-PR | pXDP25 | 1029 |
|  |  | MA-CA-NC-P1-P6 | pXDP3 | 1026 |
| 34 | 491 | MA-CA-X-(-1)-PR | pXDP26 | 1038 |
|  |  | MA-CA-NC-P1-P6 | pXDP3 | 1026 |
| 35 | 491 | MA-X-NC-(-1)-PR | pXDP27 | 1039 |
|  |  | MA-CA-NC-P1-P6 | pXDP3 | 1026 |
| 36 | 491 | MA-X-(-1)-PR | pXDP28 | 1040 |
|  |  | MA-CA-NC-P1-P6 | pXDP3 | 1026 |
| 37 | 491 | MA-X-PR | pXDP29 | 1041 |
|  |  | MA-CA-NC-P1-P6 | pXDP3 | 1026 |
| 38 | 491 | MA-CA-X-PR | pXDP30 | 1034 |
|  |  | MA-CA-NC-P1-P6 | pXDP3 | 1026 |
| 39 | 491 | MA-X | pXDP31 | 1035 |
|  |  | MA-CA-NC-P1-P6 | pXDP3 | 1026 |
| 40 | 491 | MA-CA-X | pXDP32 | 1036 |
|  |  | MA-CA-NC-P1-P6 | pXDP3 | 1026 |
| 122 | 491 | MA-CA-P1-P6-X | pXDP98 | 1042 |
| 123 | 491 | MA-CA-P1-P6-P1-P6-X | pXDP99 | 1099 |
| 124 |  | MA-CA-NC-P-/P6-P1-P6-X | pXDP100 | 1044 |
| 125 |  | MA-CA-X-P1-P6 | pXDP101 | 1045 |
| 126 |  | MA-CA-NC-X-P1-P6 | pXDP102 | 1046 |
| 128 |  | MA-CA-P2-P1-P6-X | pXDP104 | 1047 |

Example 8: Transfection and Recovery of XDP Constructs in a MA-CA-CasX Configuration Derived from Retroviruses Editing efficiency and specificity can be altered and enhanced with the method of CasX delivery that is employed. A wide variety of viral vector families, including those of retroviral origin, can be engineered for the transient delivery of CasX RNPs. In addition to potentially enhancing editing with altered cell and tissue tropism, use of RNPs packaged within these viral vectors also offers the unique advantage of negating the potential risks of insertional mutagenesis and long-term transgene expression. The purpose of the following experiment was to create and identify unique CasX delivery particles derived from different genera of the Retroviridae family using different architectures. The genera investigated in the following experiments include Alpharetroviruses, Betaretroviruses, Gammaretroviruses, Deltaretroviruses, Epsilonretroviruses and Non-primate lentiviruses in a MA-CA-CasX configuration, thereby eliminating the NC and protease domains.

Methods

Method for the Generation of XDPs

XDPs derived from Alpharetroviruses (ALV and RSV) in the MA-CA-CasX variation were produced by transient transfection of LentiX HEK293T cells (Takara Biosciences) using the three plasmids encoding the MA-CA-CasX, the glycoprotein, and the guide RNA, respectively, and listed in Table 21. The pXDP64 and pXDP65 plasmid contains the Matrix sequence followed by the Capsid sequence and a CasX 491 protein fused at the C-terminus. The cleavage site between the Capsid and the Nucleocapsid protein was kept intact for each virus and immediately preceded the CasX protein sequences to mediate separation of the editing molecules during XDP maturation, when coupled with a plasmid that contained the respective viral protease. The pStx42.174.12.7 plasmid was created with a human U6 promoter upstream of a CasX guide RNA cassette having scaffold 174 and spacer components (targeted to tdTomato: CTGCATTCTAGTTGTGGTTT, SEQ ID NO: 1018) in a single-guide format. Plasmids containing VSV-G (pGP2) for pseudotyping the XDP were also used. All plasmids contained either an ampicillin or kanamycin resistance gene. The sequences incorporated into the plasmids are presented in Table 21.

XDPs derived from Betaretroviruses (ENTV, MMTV and MPMV) in the MA-CA-CasX variation (Version 68A, 69A, 70A and 87A) were produced by transient transfection of LentiX HEK293T cells using three plasmids encoding the MA-CA-CasX, the glycoprotein, and the guide RNA, respectively, and listed in Table 21. The pXDP66, pXDP67, pXDP68 and pXDP85 plasmid contains the Matrix sequence followed by the Capsid sequence and a CasX protein fused at the C-terminus. The cleavage site between the Capsid and the Nucleocapsid protein was kept intact for each virus and immediately preceded the CasX protein sequences to mediate separation of the editing molecules during XDP maturation, when coupled with a plasmid that contained the respective viral protease. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also used. All plasmids contained either an ampicillin or kanamycin resistance gene. The sequences incorporated into the plasmids are presented in Table 21.

XDPs derived from Deltaretroviruses (BLV and HTLV1) in the MA-CA-CasX variation (Version 71A, 72A and 88A) were produced by transient transfection of LentiX HEK293T cells using the three plasmids listed in Table 21. The pXDP69, pXDP70, and pXDP86 plasmid contains the Matrix sequence followed by the Capsid sequence and a CasX protein fused at the C-terminus. The cleavage site between the Capsid and the Nucleocapsid protein was kept intact for each virus and immediately preceded the CasX protein sequences to mediate separation of the editing molecules during XDP maturation, when coupled with a plasmid that contained the respective viral protease. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also used. All plasmids contained either an ampicillin or kanamycin resistance gene. The sequences incorporated into the plasmids are presented in Table 21.

XDPs derived from Epsilonretroviruses (WDSV) in the MA-CA-CasX variation (Version 73A) were produced by transient transfection of LentiX HEK293T cells using the three plasmids listed in Table 21. The pXDP71 plasmid contains the Matrix sequence followed by the Capsid sequence and a CasX protein fused at the C-terminus. The cleavage site between the Capsid and the Nucleocapsid protein was kept intact for each virus and immediately preceded the CasX protein sequences to mediate separation of the editing molecules during XDP maturation, when coupled with a plasmid that contained the respective viral protease. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also used. All plasmids contained either an ampicillin or kanamycin resistance gene. The sequences incorporated into the plasmids are presented in Table 21.

XDPs derived from Gammaretroviruses (FLV and MMLV) in the MA-CA-CasX variation (Version 74A and 75A) were produced by transient transfection of LentiX HEK293T cells using the three plasmids listed in Table 21. The pXDP72, and pXDP73 plasmid contains the Matrix sequence followed by the Capsid sequence and a CasX protein fused at the C-terminus. The cleavage site between the Capsid and the Nucleocapsid protein was kept intact for each virus and immediately preceded the CasX protein sequences to mediate separation of the editing molecules during XDP maturation, when coupled with a plasmid that contained the respective viral protease. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also used. All plasmids contained either an ampicillin or kanamycin resistance gene. The sequences incorporated into the plasmids are presented in Table 21.

XDPs derived from Non-primate Lentiviruses (CAEV, EIAV, SIV and VMV) in the MA-CA-CasX variation (Version 76A, 77A, 78A, 79A and 89A) were produced by transient transfection of LentiX HEK293T cells using the three plasmids listed in Table 21. The pXDP74, pXDP75, pXDP76, pXDP77 and pXDP87 plasmid contains the Matrix sequence followed by the Capsid sequence and a CasX protein fused at the C-terminus. The cleavage site between the Capsid and the Nucleocapsid protein was kept intact for each virus and immediately preceded the CasX protein sequences to mediate separation of the editing molecules during XDP maturation, when coupled with a plasmid that contained the respective viral protease. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also used. All plasmids contained either an ampicillin or kanamycin resistance gene. The sequences incorporated into the plasmids of this three plasmid system are presented in Table 21.

TABLE 21

Plasmid Encoding Sequences for XDP Versions

| XDP version | Plasmid number | DNA Sequence (SEQ ID NO) |
|---|---|---|
| N/A | pStx42.174.12.7 | 1048 |
|  | pGP2 | 1003 |
| 66a | pXDP64 | 1049 |
| 67a | pXDP65 | 1050 |
| 68a | pXDP66 | 1051 |
| 69a | pXDP67 | 1052 |
| 70a | pXDP68 | 1053 |
| 71a | pXDP69 | 1054 |
| 72a | pXDP70 | 1055 |
| 73a | pXDP71 | 1056 |
| 74a | pXDP72 | 1057 |
| 75a | pXDP73 | 1058 |
| 76a | pXDP74 | 1059 |
| 77a | pXDP75 | 1060 |
| 78a | pXDP76 | 1061 |
| 79a | pXDP77 | 1062 |
| 87a | pXDP85 | 1063 |
| 88a | pXDP86 | 1064 |
| 89a | pXDP87 | 1065 |
| 59 | pXDP57 | 1066 |
| 92 | pXDP58 | 1067 |
| 60 | pXDP59 | 1068 |
| 61 | pXDP60 | 1069 |
| 62 | pXDP61 | 1070 |
| 63 | pXDP62 | 1071 |
| 64 | pXDP63 | 1072 |
| V29 | pXDP88 | 1024 |

Transfection

The steps for creation of the XDP are depicted graphically in FIG. 13. HEK293T Lenti-X® cells were maintained in 10% FBS supplemented DMEM with HEPES, penicillin/streptomycin (Pen/Step), sodium pyruvate, and 2-mercaptoethanol. Cells were seeded in two 15 cm dishes at 8e6 cells per dish in 10 mL of media. Cells were allowed to settle and grow for 24 hours before transfection. At the time of transfection cells were 70-90% confluent. For transfection, the following plasmid amounts were used for the structural plasmid individually: pXDP64 (143 µg), pXDP65 (143 µg), pXDP66 (142 µg), pXDP67 (143 µg), pXDP68 (144 µg), pXDP69 (136 µg), pXDP70 (137 µg), pXDP71 (141 µg), pXDP72 (140 µg), pXDP73 (142 µg), pXDP74 (134 µg), pXDP75 (134 µg), pXDP76 (134 µg), pXDP85 (144 µg), pXDP86 (137 µg), pXDP87 (138 µg), pXDP32 (114 µg). Along with the structural plasmid, each transfection also received 26.3 µg of pStx42.174.12.7, and the 5 µg of pGP2 in 3800 µl of Opti-MEM media. 1 mg/ml linear polyethylenimine (PEI, MW=25,000 Da) was then added to the plasmid mixture at 1:3 DNA:PEI concentration, mixed, and allowed to incubate at room temperature before being added to the cell culture.

Collection and Concentration

Media was changed on cells 24 hours post-transfection. XDP-containing media was collected 72 hours post-transfection and filtered through a 0.45 µM filter using a 60 mL syringe. The filtered supernatant was concentrated by centrifugation at 17,000×g at 4° C. for 4 hours using a 10% sucrose buffer in NTE. The concentrated XDPs were held at −20° C. until use.

Editing of tdTomato Neural Progenitor Cells Using XDP tdTomato neural progenitor cells (tdT NPCs) were grown in DMEM F12 supplemented with glutamax, HEPES, non-essential amino acids, Pen/Strep, 2-mercaptoethanol, B-27 without vitamin A, and N2. Cells were harvested using a Takara Biosciences Neuron Dissociation Kit and seeded on PLF coated 96 well plates. Cells were allowed to grow at 37° C. for 48 hours before being treated with targeting XDPs (having spacer 12.7 for tdTomato) as a 10× concentrate from the sucrose buffer concentrates using half-log dilutions. NPCs were grown for 96 hours before analysis of fluorescence as a marker of editing of tdTomato. Version 18 with pXDP32 serves as the control for these experiments.

Figure 23A:
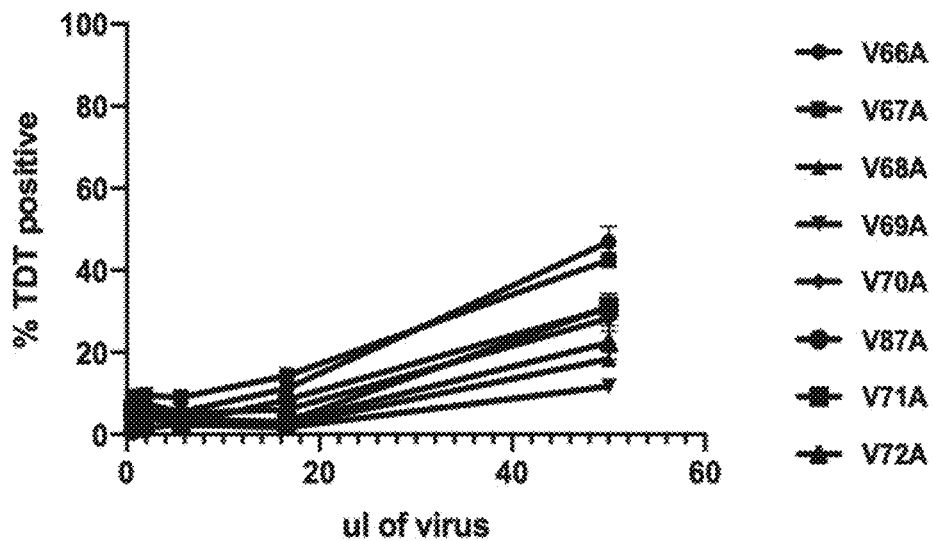
FIGS. 23A and 23B shows the results of editing assays of the various XDP versions, as described in Example 8. % TDT positive=% tdTomato positive cells.
Figure 23B:
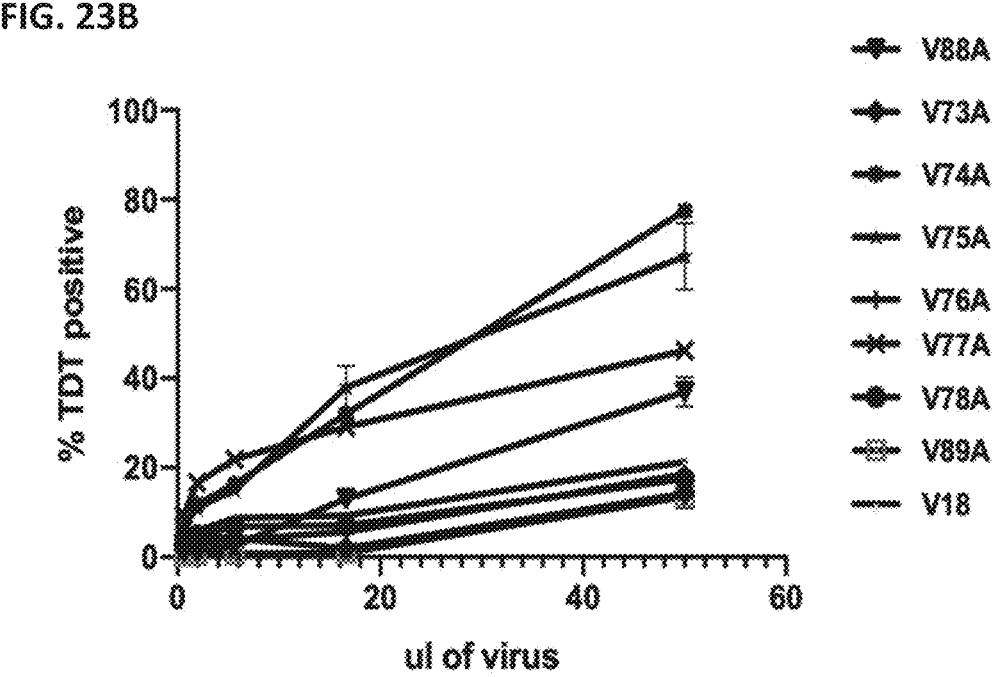
Figure 24:
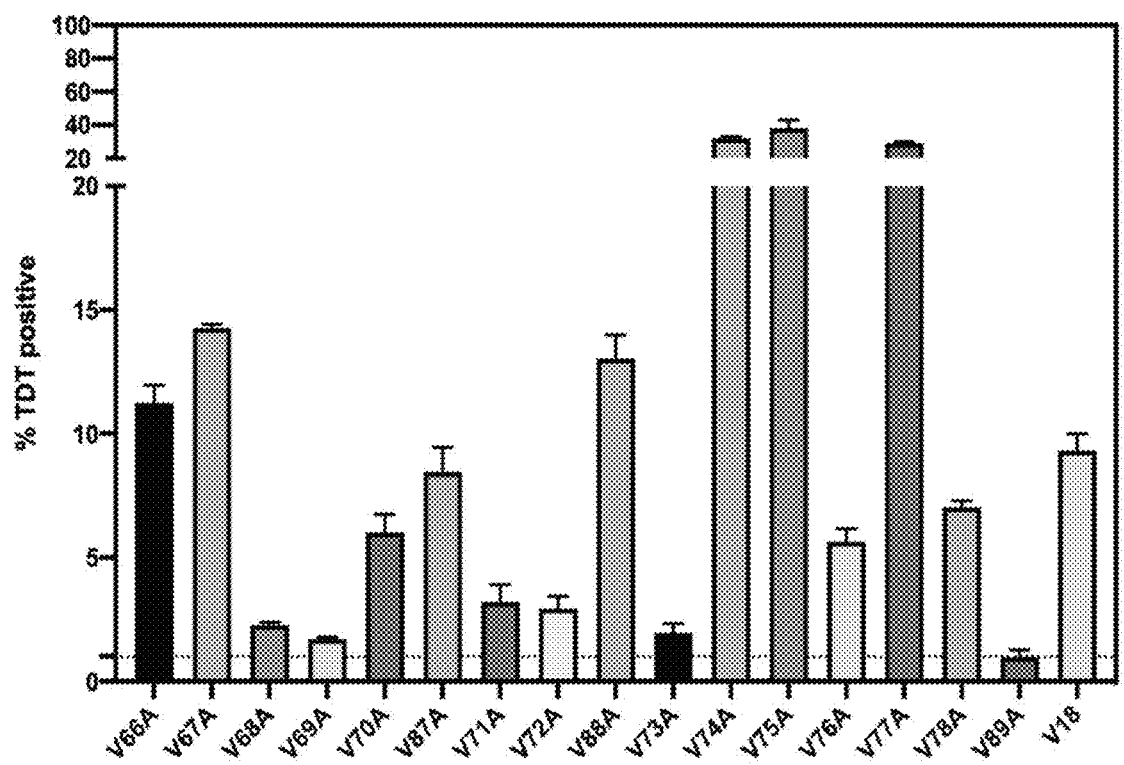
FIG. 24 shows the results of editing assays of the various XDP versions, as described in Example 8.

Results:

The results of the editing assay are shown in FIGS. 23A and 23B, FIG. 24 and in Tables 22 and 23 below. FIGS. 23A and 23B shows the percentage editing efficacy for specific amounts of the various XDP versions in tdTomato NPCs. FIG. 24 shows specifically the editing efficacy of the various XDP versions when 16.6 µl of the concentrated XDP prep is used to treat tdTomato NPCs. Tables 22 and 23 represent the results showing % editing of the dtTomato target sequence when 50 µl and 16.6 µl of the concentrated XDP prep were used to treat NPCs. The results indicate that XDPs constructed using members of the Retroviridae families in MA-CA-X configuration of the XDP structural component plasmid, were able, for the majority of the genera, to result in significant editing of the target nucleic acid in the NPC cells, with several editing above 10%.

TABLE 22

Results of Editing Assay for the first dilution (50 µl)

| XDP version | Genus/order | Virus | Plasmid number | Editing % |
|---|---|---|---|---|
| 66a | Alpharetrovirus | ALV | pXDP64 | 47.0 |
| 67a | Alpharetrovirus | RSV | pXDP65 | 42.5 |
| 68a | Betaretrovirus | ENTV | pXDP66 | 18.3 |
| 69a | Betaretrovirus | MMTV | pXDP67 | 11.7 |
| 70a | Betaretrovirus | MPMV | pXDP68 | 28.3 |
| 87a | Betaretrovirus | MPMV Native | pXDP85 | 30.8 |
| 71a | Deltaretrovirus | BLV | pXDP69 | 31.1 |
| 72a | Deltaretrovirus | HTLV1 | pXDP70 | 22.4 |
| 88a | Deltaretrovirus | HTLV1 Native | pXDP86 | 37.0 |
| 73a | Epsilonretrovirus | WDSV | pXDP71 | 14.2 |
| 74a | Gammaretrovirus | FLV | pXDP72 | 77.5 |
| 75a | Gammaretrovirus | MMLV | pXDP73 | 67.3 |
| 76a | Non-primate lentivirus | CAEV | pXDP74 | 18.5 |
| 77a | Non-primate lentivirus | EIAV | pXDP75 | 46.2 |
| 78a | Non-primate lentivirus | SIV | pXDP76 | 17.6 |
| 89a | Non-primate lentivirus | SIV Native | pXDP87 | 13.5 |
| 18 | Lentivirus | HIV | pXDP32 | 21.3 |

TABLE 23

Results of Editing Assay for the second dilution (16.6 µl)

| XDP version | Genus/order | Virus | Plasmid number | Editing % |
|---|---|---|---|---|
| 66a | Alpharetrovirus | ALV | pXDP64 | 11.2 |
| 67a | Alpharetrovirus | RSV | pXDP65 | 14.3 |
| 68a | Betaretrovirus | ENTV | pXDP66 | 2.3 |
| 69a | Betaretrovirus | MMTV | pXDP67 | 1.7 |
| 70a | Betaretrovirus | MPMV | pXDP68 | 6.0 |

TABLE 23-continued

Results of Editing Assay for the second dilution (16.6 µl)

| XDP version | Genus/order | Virus | Plasmid number | Editing % |
|---|---|---|---|---|
| 87a | Betaretrovirus | MPMV Native | pXDP85 | 8.5 |
| 71a | Deltaretrovirus | BLV | pXDP69 | 3.2 |
| 72a | Deltaretrovirus | HTLV1 | pXDP70 | 2.9 |
| 88a | Deltaretrovirus | HTLV1 Native | pXDP86 | 13.0 |
| 73a | Epsilonretrovirus | WDSV | pXDP71 | 1.9 |
| 74a | Gammaretrovirus | FLV | pXDP72 | 32.0 |
| 75a | Gammaretrovirus | MMLV | pXDP73 | 38.0 |
| 76a | Non-primate lentivirus | CAEV | pXDP74 | 5.6 |
| 77a | Non-primate lentivirus | EIAV | pXDP75 | 29.1 |
| 78a | Non-primate lentivirus | SIV | pXDP76 | 7.0 |
| 89a | Non-primate lentivirus | SIV Native | pXDP87 | 1.0 |
| 18 | Lentivirus | HIV | pXDP32 | 9.3 |

Example 9: Transfection and Recovery of XDP Constructs in the Gag-(−1)-Protease-CasX Configuration Derived from Retroviruses Editing efficiency and specificity can be altered and enhanced with the method of CasX delivery that is employed. A wide variety of viral vector families, including those of retroviral origin, can be engineered for the transient delivery of CasX RNPs. In addition to potentially enhancing editing with altered cell and tissue tropism, use of RNPs also offers the unique advantage of negating the potential risks of insertional mutagenesis and long-term transgene expression. The purpose of the following experiment was to create and identify unique CasX delivery particles derived from different genera of the Retroviridae family. The genera investigated in the following experiments include Alpharetrovirus, Betaretrovirus, Gammaretrovirus, Deltaretrovirus, Epsilonretrovirus, Non-primate lentiviruses and Spumaretrovirinae.

Method for the Generation of XDPs

XDPs derived from Alpharetroviruses (avian leukosis virus, or ALV) and rous sarcoma virus (RSV) in the Gag-protease-CasX variation (Version 44 and 45) were produced by transient transfection of LentiX HEK293T cells (Takara Biosciences) using the three plasmids listed in Table 24. The pXDP40 and pXDP41 plasmid contains the Gag polyprotein sequence followed by a protease and a CasX 491 protein fused at the C-terminus. A TSCYHCGT (SEQ ID NO: 35049) cleavage site separated the Protease protein and CasX protein sequences to mediate separation of the editing molecules during XDP maturation. The pStx42.174.12.7 plasmid was created with a human U6 promoter upstream of a CasX guide RNA cassette having scaffold 174 and spacer components (targeted to tdTomato: CTGCAT-TCTAGTTGTGGTTT, SEQ ID NO: 1018) in a single-guide format. Plasmids containing VSV-G (pGP2) for pseudotyping the XDP were also used. All plasmids contained either an ampicillin or kanamycin resistance gene. The sequences incorporated into the plasmids are presented in Table 24.

XDPs derived from Betaretroviruses (Enzootic Nasal Tumor Virus (ENTV), mouse mammary tumor virus (MMTV) and Mason-Pfizer monkey virus (MPMV)) in the Gag-(−1)-protease-CasX variation (Version 46, 47, 62 and 90) were produced by transient transfection of LentiX HEK293T cells using the three plasmids listed in Table 24. The pXDP42, pXDP43, pXDP44 and pXDP61 plasmid contains the Gag polyprotein sequence followed by ribosomal frameshift, a protease and a CasX protein fused at the C-terminus. A DCLDFDND (SEQ ID NO: 1073), DLVLL-SAE (SEQ ID NO: 1074), and PQVMAAVA (SEQ ID NO: 1075) and PQVMAAVA (SEQ ID NO: 1075) cleavage site separated the Protease protein and CasX protein sequences to mediate separation of the editing molecules during XDP maturation in the pXDP42, pXDP43, pXDP44 and pXDP61 plasmids, respectively. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also used. All plasmids contained either an ampicillin or kanamycin resistance gene. The sequences incorporated into the plasmids are presented in Table 24.

XDPs derived from Deltaretroviruses (bovine leukemia virus (BLV) and human T lymphotropic virus (HTLV1)) in the Gag-(−1)-protease-CasX variation (Version 48, 49 and 63) were produced by transient transfection of LentiX HEK293T cells using the three plasmids listed in Table 24. The pXDP45, pXDP46, and pXDP62 plasmid contains the Gag polyprotein sequence followed by ribosomal frameshift, a protease and a CasX protein fused at the C-terminus. A PAILPIIS (SEQ ID NO: 1076), PQVLPVMH (SEQ ID NO: 1077) and PQVLPVMH (SEQ ID NO: 1077) cleavage site separated the Protease protein and CasX protein sequences to mediate separation of the editing molecules during XDP maturation in the pXDP45, pXDP46, and pXDP62 plasmid respectively. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also used. All plasmids contained either an ampicillin or kanamycin resistance gene. The sequences incorporated into the plasmids are presented in Table 24.

XDPs derived from Epsilonretroviruses (walleye dermal sarcoma virus (WDSV)) in the Gag-protease-CasX variation (Version 50) were produced by transient transfection of LentiX HEK293T cells using the three plasmids portrayed in listed in Table 24. The pXDP47 plasmid contains the Gag polyprotein sequence followed by a protease and a CasX protein fused at the C-terminus. An ARQMTAHT (SEQ ID NO: 35050) cleavage site separated the Protease protein and CasX protein sequences to mediate separation of the editing molecules during XDP maturation in the pXDP47 plasmid. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also used. All plasmids contained either an ampicillin or kanamycin resistance gene. The sequences incorporated into the plasmids are presented in Table 24.

XDPs derived from Gammaretroviruses (feline leukemia virus (FLV) and murine leukemia virus (MMLV)) in the Gag-protease-CasX variation (Version 51 and 52) were produced by transient transfection of LentiX HEK293T cells using the three plasmids listed in Table 24. The pXDP48, and pXDP49 plasmid contains the Gag polyprotein sequence followed by a protease and a CasX protein fused at the C-terminus. A SSLYPVLP (SEQ ID NO: 1078), and SSLYPALT (SEQ ID NO: 1079) cleavage site separated the Protease protein and CasX protein sequences to mediate separation of the editing molecules during XDP maturation in the pXDP48, and pXDP49 plasmid respectively. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also used. All plasmids contained either an ampicillin or kanamycin resistance gene. The sequences incorporated into the plasmids are presented in Table 24.

XDPs derived from Non-primate Lentiviruses (caprine arthritis encephalitis (CAEV), equine infectious anaemia virus (EIAV), simian immunodeficiency virus (SIV) and visna maedi virus (VMV)) in the Gag-(−1)-protease-CasX variation (Version 53, 54, 55 and 91) were produced by transient transfection of LentiX HEK293T cells using the three plasmids listed in Table 24. The pXDP50, pXDP51, pXDP52, pXDP53 plasmid contains the Gag polyprotein sequence followed by a ribosomal frameshift, a protease and a CasX protein fused at the C-terminus. Cleavage sequences of AGGRSWKA (SEQ ID NO: 1080), SEEYPIMI (SEQ ID NO: 1081), GGNYPVQQ (SEQ ID NO: 1082) and REVYPIVN (SEQ ID NO: 1083) separated the Protease protein and CasX protein sequences to mediate separation of the editing molecules during XDP maturation in the pXDP50, pXDP51, pXDP52, pXDP53 plasmid respectively. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudo-typing the XDP were also used. All plasmids contained either an ampicillin or kanamycin resistance gene. The sequences incorporated into the plasmids are presented in Table 24.

XDPs derived Spumaretrovirinae family (bovine foamy virus (BFV), equine foamy virus (EFV), feline foamy virus (FFV), Brown greater galago prosimian foamy virus (BGPFV), Rhesus macaque simian foamy virus (RHSFV) and Simian foamy virus (SFV)) in the Gag-(−1)-protease-CasX variation (Version 56, 57, 58, 59, 60, 61 and 92) were produced by transient transfection of LentiX HEK293T cells using the three plasmids listed in Table 24. The pXDP54, pXDP55, pXDP56, pXDP57, pXDP58, pXDP59 and pXDP60 plasmid contains the Gag polyprotein sequence followed by a ribosomal frameshift, a protease and a CasX protein fused at the C-terminus. A SAVHSVRL (SEQ ID NO: 1084), RTVNTVRV (SEQ ID NO: 1085), NTVHTVRQVES (SEQ ID NO: 1086), AAVHTVKA (SEQ ID NO: 1087), RTVNTVTT (SEQ ID NO: 1088) and RSVNTVTA (SEQ ID NO: 1089) cleavage site separated the Protease protein and CasX protein sequences to mediate separation of the editing molecules during XDP maturation in the pXDP54, pXDP55, pXDP56, pXDP57, pXDP58, pXDP59 and pXDP60 plasmid respectively. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also used. All plasmids contained either an ampicillin or kanamycin resistance gene. The sequences incorporated into this three plasmid system are presented in Table 24.

TABLE 24

| Plasmid and XDP Encoding Sequences | | |
|---|---|---|
| XDP Version | Plasmid number | DNA Sequence (SEQ ID NO) |
|  | pStx42.174.12.7 | 1048 |
|  | pGP2 | 1003 |
| 44 | pXDP40 | 1090 |

TABLE 24-continued

Plasmid and XDP Encoding Sequences

| XDP Version | Plasmid number | DNA Sequence (SEQ ID NO) |
|---|---|---|
| 45 | pXDP41 | 1091 |
| 46 | pXDP42 | 1092 |
| 90 | pXDP43 | 1093 |
| 47 | pXDP44 | 1094 |
| 48 | pXDP45 | 1095 |
| 49 | pXDP46 | 1096 |
| 50 | pXDP47 | 1097 |
| 51 | pXDP48 | 1098 |
| 52 | pXDP49 | 1099 |
| 91 | pXDP50 | 1100 |
| 53 | pXDP51 | 1101 |
| 54 | pXDP52 | 1102 |
| 55 | pXDP53 | 1103 |
| 56 | pXDP54 | 1104 |
| 57 | pXDP55 | 1105 |
| 58 | pXDP56 | 1106 |
| 59 | pXDP57 | 1066 |
| 92 | pXDP58 | 1067 |
| 60 | pXDP59 | 1068 |
| 61 | pXDP60 | 1069 |
| 62 | pXDP61 | 1070 |
| 63 | pXDP62 | 1071 |
| 64 | pXDP63 | 1072 |
| V29 | pXDP88 | 1024 |

Transfection

The steps for creation of the XDP are depicted graphically in FIG. 13. HEK293T Lenti-X® cells were maintained in 10% FBS supplemented DMEM with HEPES, penicillin/streptomycin (Pen/Step), sodium pyruvate, and 2-mercaptoethanol. Cells were seeded in two 15 cm dishes at 8e6 cells per dish in 10 mL of media. Cells were allowed to settle and grow for 24 hours before transfection. At the time of transfection cells were 70-90% confluent. For transfection, the following plasmid amounts were used for the structural plasmid individually: pXDP40 (151 µg), pXDP41 (151 µg), pXDP42 (157 µg), pXDP43 (157 µg), pXDP44 (159 µg), pXDP45 (145 µg), pXDP46 (149 µg), pXDP47 (152 µg), pXDP48 (148 µg), pXDP49 (149 µg), pXDP50 (145 µg), pXDP51 (146 µg), pXDP52 (147 µg), pXDP53 (144 µg), pXDP54 (149 µg), pXDP55 (153 µg), pXDP56 (154 µg), pXDP57 (150 µg), pXDP58 (146 µg), pXDP59 (154 µg), pXDP60 (154 µg), pXDP61 (159 µg), pXDP62 (149 µg), pXDP63 (147 µg), pXDP88 (146 µg). Along with the structural plasmid, each transfection also received 26.3 µg of pStx42.174.12.7, and the 5 µg of pGP2 in 3800 µl of Opti-MEM media. 1 mg/ml linear polyethylenimine (PEI, MW=25,000 Da) was then added to the plasmid mixture at 1:3 DNA:PEI concentration, mixed, and allowed to incubate at room temperature before being added to the cell culture.

Collection and Concentration

XDPs were collected, concentrated, and stored as described in Example 8, above.

Editing of tdTomato Neural Progenitor Cells Using XDP tdTomato neural progenitor cells (tdT NPCs) were grown in DMEM F12 supplemented with glutamax, HEPES, non-essential amino acids, Pen/Strep, 2-mercaptoethanol, B-27 without vitamin A, and N2. Cells were harvested using a Takara Biosciences Neuron Dissociation Kit and seeded on PLF coated 96 well plates. Cells were allowed to grow at 37° C. for 48 hours before being treated with targeting XDPs (having spacer 12.7 for tdTomato) as a 10× concentrate from the sucrose buffer concentrates using half-log dilutions. NPCs were grown for 96 hours before analysis of fluorescence as a marker of editing of tdTomato. Version 29 XDP made with pXDP88 is the HIV lentivirus control for these experiments testing out Gag-Pro-Stx versions of the various retroviruses.

Results:

The results of the editing assay are shown in Table 25 and Table 26 below. Tables 25 and 26 represent the results showing % editing of the dtTomato target sequence when 50 µl and 16.6 µl of the concentrated XDP prep were used to treat NPCs. The results indicate that XDPs constructed using members of the Retroviridae in several different configurations of the XDP with the inclusion of a protease and protease cleavage sequences between the components of the Gag-protease-CasX plasmid, were able, for the majority of the genera, to result in significant editing of the target nucleic acid in the NPC cells, with several editing above 10%.

TABLE 25

Results of Editing Assay for the first dilution (50 µl)

| XDP Version | Genus/order | Virus | Plasmid number | Editing % |
|---|---|---|---|---|
| 44 | Alpharetrovirus | ALV | pXDP40 | 91.5 |
| 45 | Alpharetrovirus | RSV | pXDP41 | 4.3 |
| 46 | Betaretrovirus | ENTV | pXDP42 | 9.1 |
| 90 | Betaretrovirus | MMTV | pXDP43 | 7.3 |
| 47 | Betaretrovirus | MPMV | pXDP44 | 30.5 |
| 62 | Betaretrovirus | MPMV Native | pXDP61 | 30.8 |
| 48 | Deltaretrovirus | BLV | pXDP45 | 19.4 |
| 49 | Deltaretrovirus | HTLV1 | pXDP46 | 20.1 |
| 63 | Deltaretrovirus | HTLV1 Native | pXDP62 | 37.0 |
| 50 | Epsilonretrovirus | WDSV | pXDP47 | 10.9 |
| 51 | Gammaretrovirus | FLV | pXDP48 | 6.7 |
| 52 | Gammaretrovirus | MMLV | pXDP49 | 12.4 |
| 91 | Non-primate lentivirus | CAEV | pXDP50 | 8.2 |
| 53 | Non-primate lentivirus | EIAV | pXDP51 | 5.3 |
| 54 | Non-primate lentivirus | SIV | pXDP52 | 11.7 |
| 64 | Non-primate lentivirus | SIV Native | pXDP63 | 13.5 |
| 55 | Non-primate lentivirus | VMV | pXDP53 | 8.7 |
| 56 | Spumaretrovirinae | BFV | pXDP54 | 3.6 |
| 57 | Spumaretrovirinae | BGPFV | pXDP55 | 8.9 |
| 58 | Spumaretrovirinae | CCFV | pXDP56 | 5.5 |
| 59 | Spumaretrovirinae | EFV | pXDP57 | 4.4 |
| 92 | Spumaretrovirinae | FFV | pXDP58 | 7.3 |
| 60 | Spumaretrovirinae | RHSFV | pXDP59 | 4.2 |
| 61 | Spumaretrovirinae | SFV | pXDP60 | 4.5 |
| 29 | Lentivirus | HIV | pXDP88 | 7.4 |

TABLE 26

Results of Editing Assay for the second dilution (16.6 µl)

| XDP Version | Genus/order | Virus | Plasmid number | Editing % |
|---|---|---|---|---|
| 44 | Alpharetrovirus | ALV | pXDP40 | 85.7 |
| 45 | Alpharetrovirus | RSV | pXDP41 | 2.9 |
| 46 | Betaretrovirus | ENTV | pXDP42 | 2.3 |
| 90 | Betaretrovirus | MMTV | pXDP43 | 7.6 |
| 47 | Betaretrovirus | MPMV | pXDP44 | 2.6 |
| 62 | Betaretrovirus | MPMV Native | pXDP61 | 8.5 |
| 48 | Deltaretrovirus | BLV | pXDP45 | 15.2 |
| 49 | Deltaretrovirus | HTLV1 | pXDP46 | 1.8 |
| 63 | Deltaretrovirus | HTLV1 Native | pXDP62 | 13.0 |
| 50 | Epsilonretrovirus | WDSV | pXDP47 | 1.1 |
| 51 | Gammaretrovirus | FLV | pXDP48 | 7.8 |
| 52 | Gammaretrovirus | MMLV | pXDP49 | 6.3 |

TABLE 26-continued

Results of Editing Assay for the second dilution (16.6 µl)

| XDP Version | Genus/order | Virus | Plasmid number | Editing % |
|---|---|---|---|---|
| 91 | Non-primate lentivirus | CAEV | pXDP50 | 3.1 |
| 53 | Non-primate lentivirus | EIAV | pXDP51 | 3.8 |
| 54 | Non-primate lentivirus | SIV | pXDP52 | 1.3 |
| 64 | Non-primate lentivirus | SIV Native | pXDP63 | 1.0 |
| 55 | Non-primate lentivirus | VMV | pXDP53 | 7.4 |
| 56 | Spumaretrovirinae | BFV | pXDP54 | 1.9 |
| 57 | Spumaretrovirinae | BGPFV | pXDP55 | 4.5 |
| 58 | Spumaretrovirinae | CCFV | pXDP56 | 3.7 |
| 59 | Spumaretrovirinae | EFV | pXDP57 | 2.7 |
| 92 | Spumaretrovirinae | FFV | pXDP58 | 1.7 |
| 60 | Spumaretrovirinae | RHSFV | pXDP59 | 3.4 |
| 61 | Spumaretrovirinae | SFV | pXDP60 | 1.8 |
| 29 | Lentivirus | HIV | pXDP88 | 5.3 |

Example 10: Transfection and Recovery of XDP Constructs in the Gag-CasX Configuration Derived from Retroviruses Editing efficiency and specificity can be altered and enhanced with the method of CasX delivery that is employed. A wide variety of viral vector families, including those of retroviral origin, can be engineered for the transient delivery of CasX RNPs. In addition to potentially enhancing editing with altered cell and tissue tropism, use of RNPs packaged within these viral vectors also offers the advantage of negating the potential risks of insertional mutagenesis and long-term transgene expression. The purpose of the following experiment was to build upon the previous example and to create and identify unique CasX delivery particles derived from different genera of the Retroviridae family using different architectures. The genera investigated in the following experiments include Alpharetroviruses, Betaretroviruses, Gammaretroviruses, Deltaretroviruses, Epsilonretroviruses and Non-primate lentiviruses in a Gag-CasX configuration. The experiments were meant to be a direct comparison with the HIV Lentivirus based V7 construct, with the Gag component being replaced with the corresponding Gag components of Alpharetroviruses, Betaretroviruses, Gammaretroviruses, Deltaretroviruses, Epsilonretroviruses, Non-primate lentiviruses and Spumaretroviruses, with the protease domains eliminated in all constructs to test whether XDP capable of editing required active release from Gag.

Methods for the Generation of XDPs

XDPs derived from Alpharetroviruses (avian leukosis virus (ALV) and rous sarcoma virus (RSV)) in the Gag-CasX variation (V102 and V114) were produced by transient transfection of LentiX HEK293T cells (Takara Biosciences) using the three plasmids listed in Table 27. The pXDP127 and pXDP139 plasmid contains the Gag polyprotein sequence followed by the CasX 491 protein fused at the C-terminus. The pStx42.174.12.7 plasmid was created with a human U6 promoter upstream of a CasX guide RNA cassette having scaffold 174 and spacer components (targeted to tdTomato: CTGCATTCTAGTTGTGGTTT, SEQ ID NO: 1018) in a single-guide format. Plasmids containing VSV-G (pGP2) for pseudotyping the XDP were also incorporated into the constructs. All plasmids contained either an ampicillin or kanamycin resistance gene. The sequences incorporated into the plasmids are presented in Table 27.

XDPs derived from Betaretroviruses (Enzootic Nasal Tumor Virus (ENTV), mouse mammary tumor virus (MMTV) and Mason-Pfizer monkey virus (MPMV)) in the Gag-CasX variation (V106, V111, V112 and V113) were produced by transient transfection of LentiX HEK293T cells using the three plasmids listed in Table 27. The pXDP131, pXDP136, pXDP137 and pXDP138 plasmid contains the Gag polyprotein sequence followed by the CasX 491 protein fused at the C-terminus. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also incorporated into the constructs. All plasmids contained either an ampicillin or kanamycin resistance gene. The sequences incorporated into the plasmids are presented in Table 27.

XDPs derived from Deltaretroviruses (bovine leukemia virus (BLV) and human T lymphotropic virus (HTLV1)) in the Gag-CasX variation (versions V103, V108 and V109) were produced by transient transfection of LentiX HEK293T cells using the three plasmids listed in Table 27. The pXDP128, pXDP133 and pXDP134 plasmid contains the Gag polyprotein sequence followed by the CasX 491 protein fused at the C-terminus. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also incorporated into the constructs. All plasmids contained either an ampicillin or kanamycin resistance gene. The sequences incorporated into the plasmids are presented in Table 27.

XDPs derived from Epsilonretroviruses (walleye dermal sarcoma virus (WDSV)) in the Gag-CasX variation (Version 73A) were produced by transient transfection of LentiX HEK293T cells using the three plasmids listed in Table 27. The pXDP127 and pXDP139 plasmid contains the Gag polyprotein sequence followed by the CasX 491 protein fused at the C-terminus. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also incorporated into the constructs. All plasmids contained either an ampicillin or kanamycin resistance gene. The sequences incorporated into the plasmids are presented in Table 27.

XDPs derived from Gammaretroviruses (feline leukemia virus (FLV) and murine leukemia virus (MMLV)) in the Gag-CasX variation (V107 and V110) were produced by transient transfection of LentiX HEK293T cells using the three plasmids listed in Table 27. The pXDP132, and pXDP135 plasmid contains the Gag polyprotein sequence followed by the CasX 491 protein fused at the C-terminus. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also incorporated into the constructs. All plasmids contained either an ampicillin or kanamycin resistance gene. The sequences incorporated into the plasmids are presented in Table 27.

XDPs derived from Non-primate Lentiviruses (caprine arthritis encephalitis (CAEV), equine infectious anaemia virus (EIAV), simian immunodeficiency virus (SIV) and visna maedi virus (VMV)) in the Gag-CasX variation (V104, V105, V115, V116 and V117) were produced by transient transfection of LentiX HEK293T cells using the three plasmids listed in Table 27. The pXDP129, pXDP130, pXDP140, pXDP141 and pXDP142 plasmid contains the Gag polyprotein sequence followed by the CasX 491 protein fused at the C-terminus. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudo-typing the XDP were also incorporated into the constructs. All plasmids contained either an ampicillin or kanamycin resistance gene. The sequences incorporated into the plasmids are presented in Table 27.

XDPs derived Spumaretrovirinae family (bovine foamy virus (BFV), equine foamy virus (EFV), feline foamy virus (FFV), Brown greater galago prosimian foamy virus (BGPFV), Rhesus macaque simian foamy virus (RHSFV) and Simian foamy virus (SFV)) in the Gag-CasX variation (V80a, V81a, V82a, V83a, V84a, V85a and V86a) were produced by transient transfection of LentiX HEK293T cells using the three plasmids listed in Table 27. The pXDP78, pXDP79, pXDP80, pXDP81, pXDP82, pXDP83 and pXDP84 plasmid contains the Gag polyprotein sequence followed by the CasX protein fused at the C-terminus. The pStx42.174.12.7 plasmid was created with a human U6 promoter upstream of a CasX guide cassette having scaffold 174 and spacer components (targeted to tdTomato) in a single-guide format. Plasmids containing VSV-G (pGP2) for pseudotyping the XDP were also incorporated into the constructs. All plasmids contained either an ampicillin or kanamycin resistance gene. The sequences incorporated into the plasmids are presented in Table 27.

TABLE 27

XDP Plasmid and Encoding Sequences

| XDP version | Plasmid number | DNA Sequence (SEQ ID NO) |
|---|---|---|
| N/A | pStx42.174.12.7 | 1048 |
|  | pGP2 | 1003 |
| 102 | pXDP127 | 1107 |
| 103 | pXDP128 | 1108 |
| 104 | pXDP129 | 1109 |
| 105 | pXDP130 | 1110 |
| 106 | pXDP131 | 1111 |
| 107 | pXDP132 | 1112 |
| 108 | pXDP133 | 1113 |
| 109 | pXDP134 | 1114 |
| 110 | pXDP135 | 1115 |
| 111 | pXDP136 | 1116 |
| 112 | pXDP137 | 1117 |
| 113 | pXDP138 | 1118 |
| 114 | pXDP139 | 1119 |
| 115 | pXDP140 | 1120 |
| 116 | pXDP141 | 1121 |
| 117 | pXDP142 | 1122 |
| 118 | pXDP143 | 1123 |
| 80a | pXDP78 | 1124 |
| 81a | pXDP79 | 1125 |
| 82a | pXDP80 | 1126 |
| 83a | pXDP81 | 1127 |
| 84a | pXDP82 | 1128 |
| 85a | pXDP83 | 1129 |
| 86a | pXDP84 | 1130 |
| 29 | pXDP88 | 1024 |

Transfection

The steps for creation of the XDP are depicted graphically in FIG. 13. HEK293T Lenti-X cells were maintained in 10% FBS supplemented DMEM with HEPES, penicillin/streptomycin (Pen/Step), sodium pyruvate, and 2-mercaptoethanol. Cells were seeded in two 15 cm dishes at 8e6 cells per dish in 10 mL of media. Cells were allowed to settle and grow for 24 hours before transfection. At the time of transfection cells were 70-90% confluent. For transfection, the following plasmid amounts were used for the structural plasmid individually: pXDP127 (146 µg), pXDP129 (141 µg), pXDP130 (143 µg), pXDP131 (145 µg), pXDP132 (143 µg), pXDP135 (145 µg), pXDP136 (152 µg), pXDP138 (149 µg), pXDP139 (146 µg), pXDP140 (143 µg), pXDP141 (143 µg), pXDP142 (141 µg), pXDP143 (146 µg), pXDP78 (145 µg), pXDP81 (141 µg), pXDP82 (139 µg), pXDP83 (145 µg), pXDP0017 (122 µg). Along with the structural plasmid, each transfection also received 26.3 µg of pStx42.174.12.7, and the 5 µg of pGP2 in 3800 µl of Opti-MEM media. 1 mg/ml linear polyethylenimine (PEI, MW=25,000 Da) was then added to the plasmid mixture at 1:3 DNA:PEI concentration, mixed, and allowed to incubate at room temperature before being added to the cell culture.

Collection and Concentration

XDPs were collected, concentrated, and stored as described in Example 8, above.

Editing of tdTomato Neural Progenitor Cells Using XDP tdTomato neural progenitor cells (tdT NPCs) were grown in DMEM F12 supplemented with glutamax, HEPES, nonessential amino acids, Pen/Strep, 2-mercaptoethanol, B-27 without vitamin A, and N2. Cells were harvested using a Takara Biosciences Neuron Dissociation Kit and seeded on PLF coated 96 well plates. Cells were allowed to grow at 37° C. for 48 hours before being treated with targeting XDPs (having spacer 12.7 for tdTomato) as a 10× concentrate from the sucrose buffer concentrates using half-log dilutions. NPCs were grown for 96 hours before analysis of fluorescence as a marker of editing of tdTomato. Version 18 with pXDP32 serves as the control for these experiments.

Figure 27A:
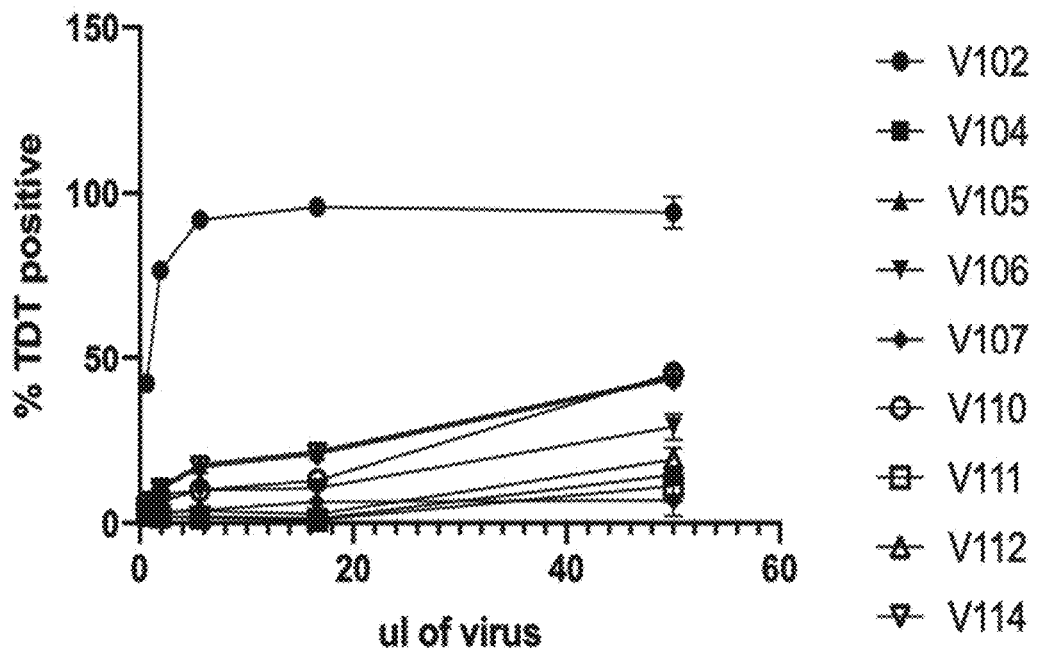
FIGS. 27A and 27B shows the results of editing assays of the various XDP versions, as described in Example 11.
Figure 27B:
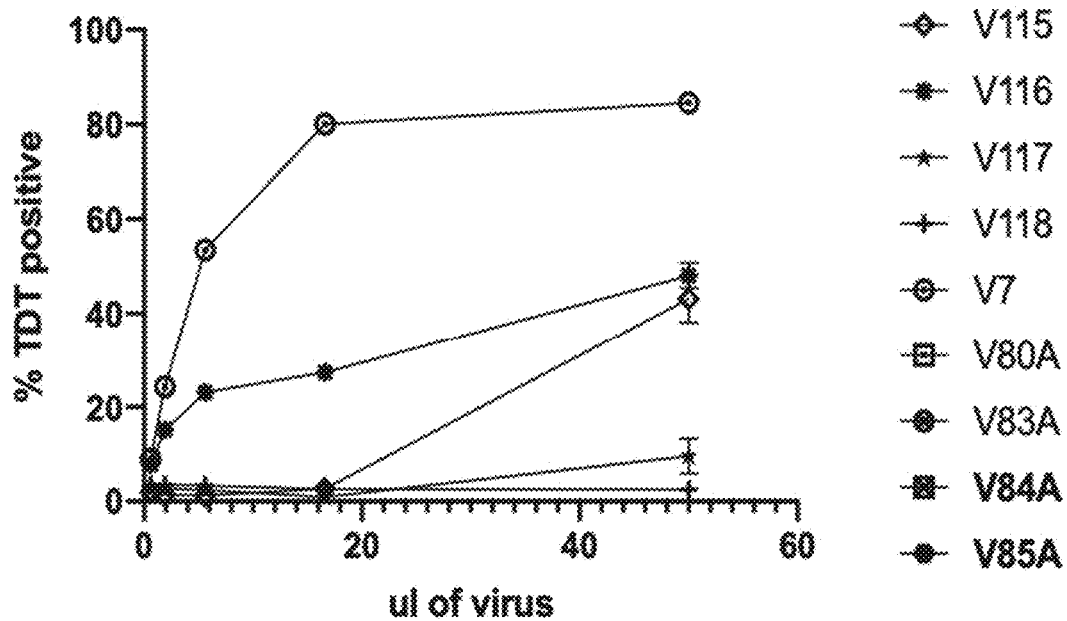
Figure 28:
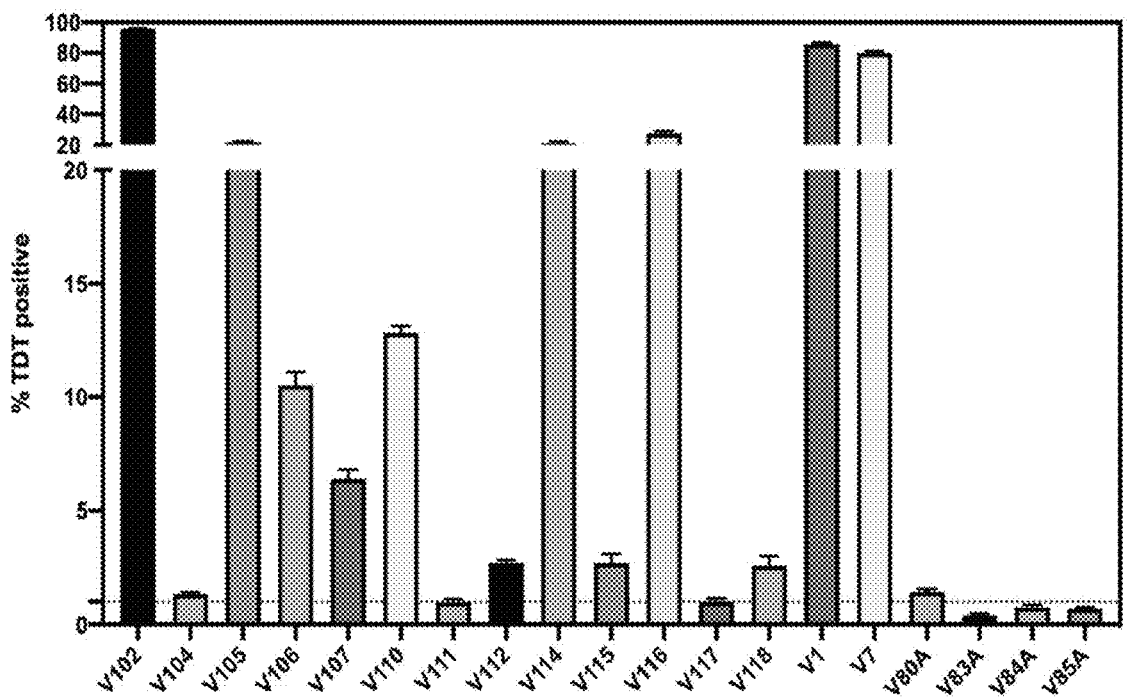
FIG. 28 shows the results of editing assays of the various XDP versions, as described in Example 10.

Results: The results of the editing assay are shown in FIGS. 27A and 27B, FIG. 28 and in Table 28 and Table 29 below. FIGS. 27A and 27B shows the percentage editing efficacy for specific amounts of the various XDP versions in tdTomato NPCs. Tables 28 and 29 represent the results showing % editing of the tdTomato target sequence when 50 ul and 16.6 ul of the concentrated XDP prep were used to treat NPCs. The results indicate that XDPs constructed using members of the Retroviridae in Gag-CasX configuration of the XDP without inclusion of a protease, were able, for the majority of the genera, to result in significant editing of the target nucleic acid in the NPC cells, with several editing above 4%.

TABLE 28

Results of Editing Assay for the first dilution (50 ul)

| XDP version | Genus/order | Virus | Plasmid number | Editing % |
|---|---|---|---|---|
| 102 | Alpharetrovirus | ALV | pXDP127 | 94.2 |
| 114 | Alpharetrovirus | RSV | pXDP139 | 43.4 |
| 106 | Betaretrovirus | ENTV | pXDP131 | 29.1 |
| 111 | Betaretrovirus | MMTV | pXDP136 | 11.1 |
| 113 | Betaretrovirus | MPMV Native | pXDP138 | 19.2 |
| 118 | Epsilonretrovirus | WDSV | pXDP143 | 2.5 |
| 107 | Gammaretrovirus | FLV | pXDP132 | 6.8 |
| 110 | Gammaretrovirus | MMLV | pXDP135 | 45.2 |
| 104 | Non-primate lentivirus | CAEV | pXDP129 | 14.6 |

TABLE 28-continued

Results of Editing Assay for the first dilution (50 ul)

| XDP version | Genus/order | Virus | Plasmid number | Editing % |
|---|---|---|---|---|
| 105 | Non-primate lentivirus | EIAV | pXDP130 | 44.2 |
| 115 | Non-primate lentivirus | SIV | pXDP140 | 43.1 |
| 116 | Non-primate lentivirus | SIV Native | pXDP141 | 48.1 |
| 117 | Non-primate lentivirus | VMV | pXDP142 | 9.6 |
| 7 | Lentivirus | HIV | pXDP0017 | 84.5 |
| 80a | Spumaretrovirus | BFV | pXDP78 | 29.2 |
| 83a | Spumaretrovirus | EFV | pXDP81 | 4.7 |
| 84a | Spumaretrovirus | FFV | pXDP82 | 4.9 |
| 85a | Spumaretrovirus | RHSFV | pXDP83 | 4.1 |

TABLE 29

Results of Editing Assay for the second dilution (16.6ul)

| XDP version | Genus/order | Virus | Plasmid number | Editing % |
|---|---|---|---|---|
| 102 | Alpharetrovirus | ALV | pXDP127 | 95.8 |
| 114 | Alpharetrovirus | RSV | pXDP139 | 20.9 |
| 106 | Betaretrovirus | ENTV | pXDP131 | 10.5 |
| 111 | Betaretrovirus | MMTV | pXDP136 | 1.0 |
| 113 | Betaretrovirus | MPMV Native | pXDP138 | 2.7 |
| 118 | Epsilonretrovirus | WDSV | pXDP143 | 2.6 |
| 107 | Gammaretrovirus | FLV | pXDP132 | 6.4 |
| 110 | Gammaretrovirus | MMLV | pXDP135 | 12.8 |
| 104 | Non-primate lentivirus | CAEV | pXDP129 | 1.3 |
| 105 | Non-primate lentivirus | EIAV | pXDP130 | 21.7 |
| 115 | Non-primate lentivirus | SIV | pXDP140 | 2.7 |
| 116 | Non-primate lentivirus | SIV Native | pXDP141 | 27.3 |
| 117 | Non-primate lentivirus | VMV | pXDP142 | 1.0 |
| 7 | Lentivirus | HIV | pXDP0017 | 80.0 |
| 80a | Spumaretrovirus | BFV | pXDP78 | 1.4 |
| 83a | Spumaretrovirus | EFV | pXDP81 | 0.4 |
| 84a | Spumaretrovirus | FFV | pXDP82 | 0.7 |
| 85a | Spumaretrovirus | RHSFV | pXDP83 | 0.7 |

Example 11: Transfection and Recovery of XDP Constructs Derived from Spumaretrovirinae Editing efficiency and specificity can be altered and enhanced with the method of CasX delivery that is employed. A wide variety of viral vector families, including those of retroviral origin, can be engineered for the transient delivery of CasX RNPs. In addition to potentially enhancing editing with altered cell and tissue tropism, use of RNPs packaged within these viral vectors also offers the unique advantage of negating the potential risks of insertional mutagenesis and long-term transgene expression. The purpose of the following experiment was to build upon the previous example and to create and identify unique CasX delivery particles derived from different genera of the Retroviridae family using different architectures. The genera investigated in the following experiments include Spumaretroviruses in a Gag-CasX+Gag-(−1)-Protease-CasX configuration. Here we hypothesized that by inclusion of the protease with the Gag-Protease-CasX polyprotein along with the Gag-CasX polyproteins, we could potentially improve XDP particle formation and maturation, mediated by proteolytic cleavage.

Method for the Generation of XDPs

XDPs derived from Spumaretrovirinae family (BFV, EFV, FFV, BGPFV, RHSFV and SFV) in the 90% Gag-CasX+ 10% Gag-(−1)-Protease-CasX variation (V80b, V81b, V82b, V83b, V84b, V85b and V86b) were produced by transient transfection of LentiX HEK293T cells (Takara Biosciences) using the plasmids listed in Table 30. The plasmids pXDP54, pXDP55, pXDP56, pXDP57, pXDP58, pXDP59 and pXDP60 have been described in previous examples. The pStx42.174.12.7 plasmid was created with a human U6 promoter upstream of a CasX guide RNA cassette having scaffold 174 and spacer components (targeted to tdTomato: CTGCATTCTAGTTGTGGTTT, SEQ ID NO: 1018) in a single-guide format. Plasmids containing VSV-G (pGP2) for pseudotyping the XDP were also used. All plasmids contained either an ampicillin or kanamycin resistance gene. The sequences incorporated into the plasmids are presented in Table 30.

TABLE 30

Plasmid Sequences

| XDP version | Plasmid number | DNA Sequence (SEQ ID NO) |
|---|---|---|
| N/A | pStx42.174.12.7 | 1048 |
|  | pGP2 | 1003 |
| 80a | pXDP78 | 1124 |
| 81a | pXDP79 | 1125 |
| 82a | pXDP80 | 1126 |
| 83a | pXDP81 | 1127 |
| 84a | pXDP82 | 1128 |
| 85a | pXDP83 | 1129 |
| 86a | pXDP84 | 1130 |

Transfection

The steps for creation of the XDP are depicted graphically in FIG. 13. HEK293T Lenti-X cells were maintained in 10% FBS supplemented DMEM with HEPES, penicillin/streptomycin (Pen/Step), sodium pyruvate, and 2-mercaptoethanol. Cells were seeded in two 15 cm dishes at 8e6 cells per dish in 10 mL of media. Cells were allowed to settle and grow for 24 hours before transfection. At the time of transfection cells were 70-90% confluent. For transfection, the following plasmid amounts were used for the structural plasmid individually: pXDP78+pXDP54 (146 µg+15 µg), pXDP81+pXDP57 (150 µg+15 µg), pXDP82+pXDP58 (146 µg+15 µg), pXDP83+pXDP59 (154 µg+15.4 µg), pXDP78 (145 µg), pXDP81 (141 µg), pXDP82 (139 µg), and pXDP83 (145 µg). Along with the structural plasmid, each transfection also received 26.3 µg of pStx42.174.12.7, and the 5 µg of pGP2 in 3800 µl of Opti-MEM media. 1 mg/ml linear polyethylenimine (PEI, MW=25,000 Da) was then added to the plasmid mixture at 1:3 DNA:PEI concentration, mixed, and allowed to incubate at room temperature before being added to the cell culture.

Collection and Concentration

XDPs were collected, concentrated, and stored as described in Example, above.

Editing of tdTomato Neural Progenitor Cells Using XDP tdTomato neural progenitor cells (tdT NPCs) were grown in DMEM F12 supplemented with glutamax, HEPES, non-essential amino acids, Pen/Strep, 2-mercaptoethanol, B-27 without vitamin A, and N2. Cells were harvested using a Takara Biosciences Neuron Dissociation Kit and seeded on PLF coated 96 well plates. Cells were allowed to grow at 37° C. for 48 hours before being treated with targeting XDPs (having a spacer for tdTomato) as a 10× concentrate from the sucrose buffer concentrates using half-log dilutions. NPCs were grown for 96 hours before analysis of fluorescence as a marker of editing of tdTomato. Version 18 with pXDP32 serves as the control for these experiments.

Figure 25A:
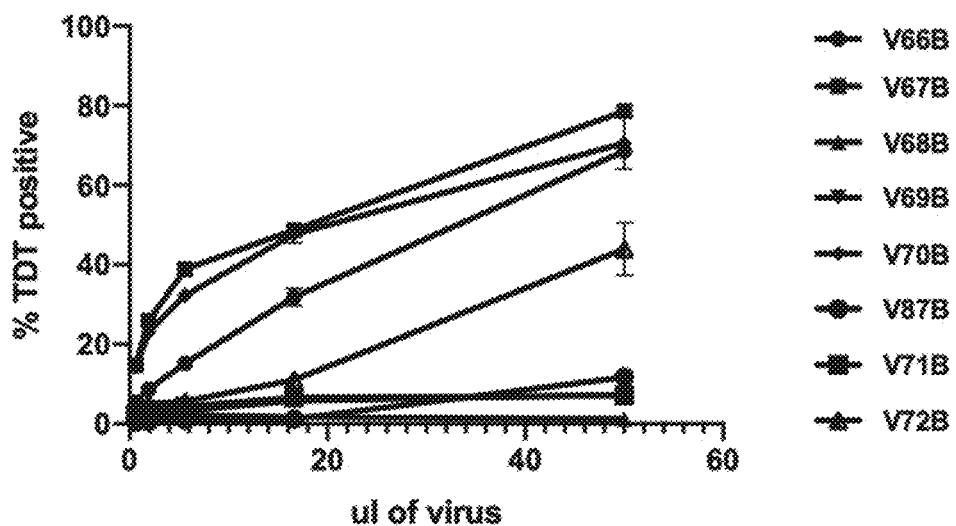
FIGS. 25A and 25B shows the results of editing assays of the various XDP versions, as described in Example 11.
Figure 25B:
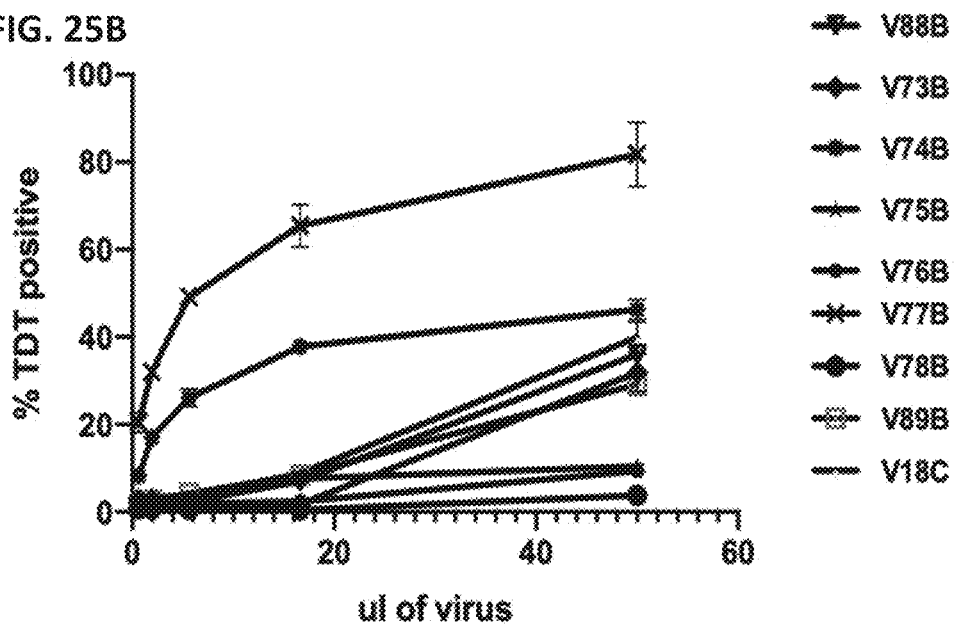
Figure 26:
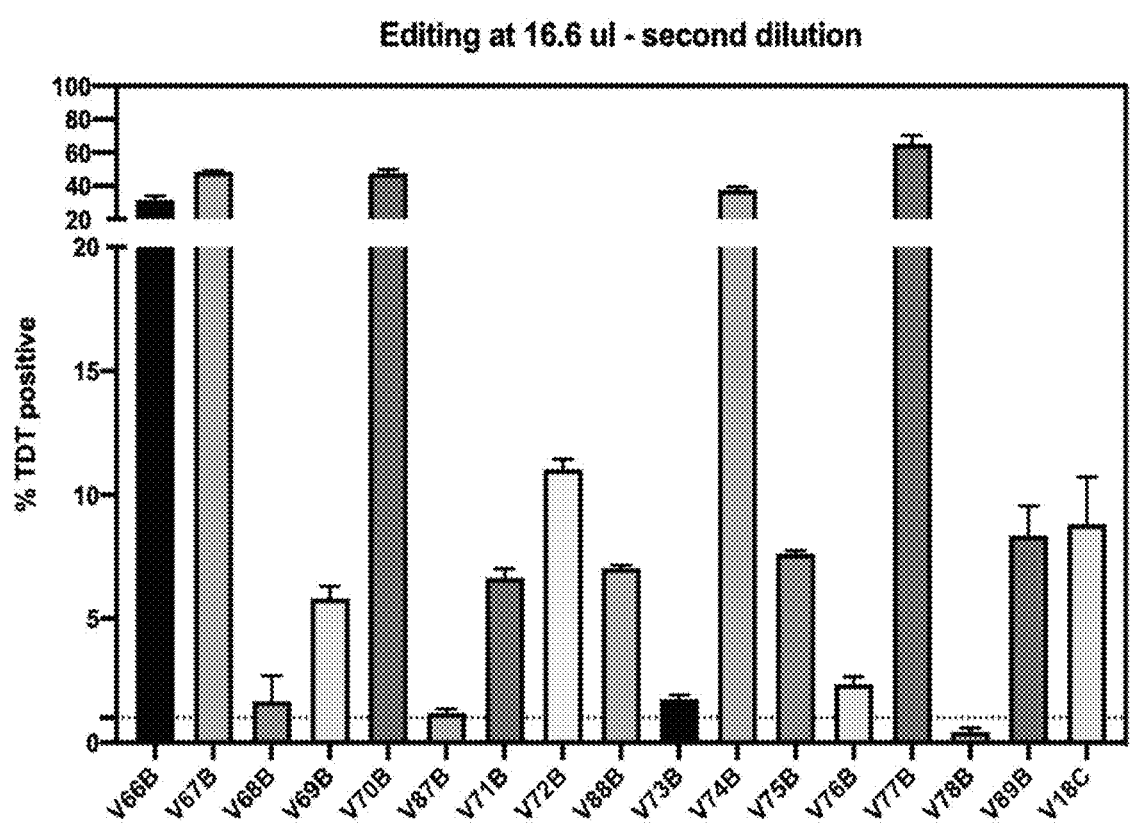
FIG. 26 shows the results of editing assays of the various XDP versions, as described in Example 11.
Figure 29:
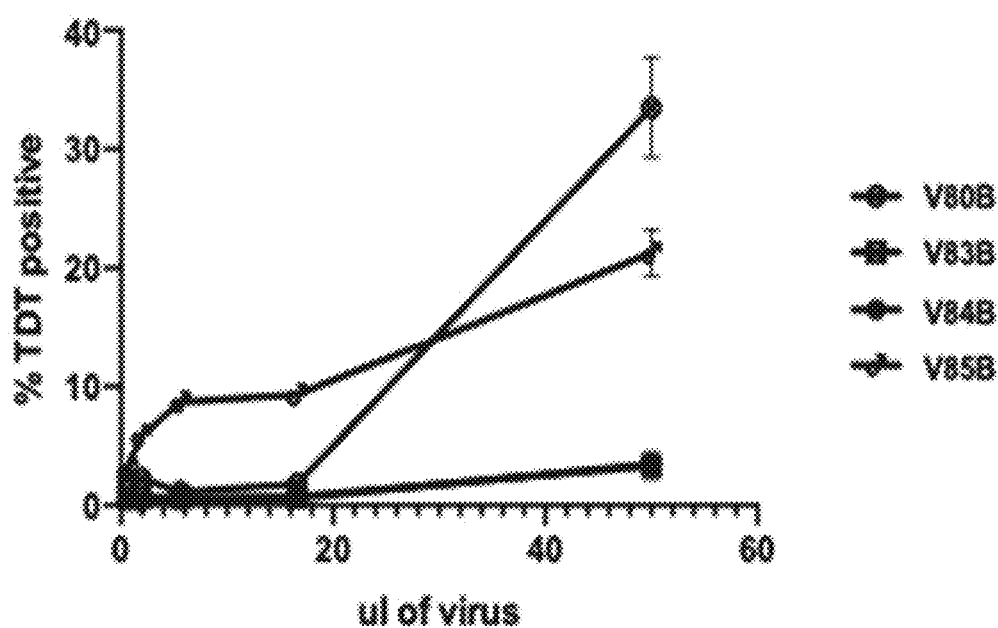
FIG. 29 shows the results of editing assays of the various XDP versions, as described in Example 11.
Figure 30:
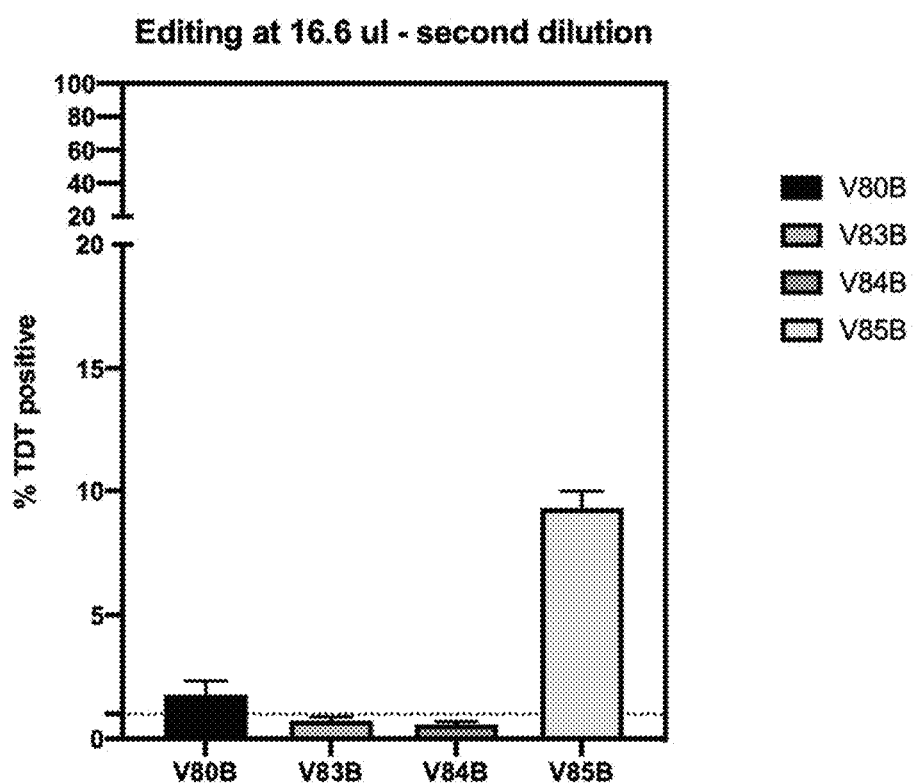
FIG. 30 shows the results of editing assays of the various XDP versions, as described in Example 11.

Results:

The results of the editing assay are shown in FIGS. 25A-25B, FIG. 26, FIG. 29, FIG. 30 and in Table 31 and Table 32 below. FIGS. 25A-25B and FIG. 29 shows the percentage editing efficacy for specific amounts of the various XDP versions in tdTomato NPCs. FIGS. 27A-27B and 30 show specifically the editing efficacy of the various XDP versions when 16.6 µl of the concentrated XDP prep is used to treat tdTomato NPCs. Tables 31 and 32 represent the results showing % editing of the dtTomato target sequence when 50 µl and 16.6 µl of the concentrated XDP prep were used to treat NPCs. The results indicate that XDPs constructed using members of the Retroviridae in 90% Gag-CasX+10% Gag-protease-CasX configuration of the XDP, were able, for the majority of the genera, to result in significant editing of the target nucleic acid in the NPC cells, with several editing above 10%, supporting the inclusion of the protease component.

TABLE 31

Results of Editing Assay for the first dilution (50 ul)

| XDP version | Genus/order | Virus | Plasmid numbers | Editing % |
|---|---|---|---|---|
| 66B | Spumaretrovirus | BFV | pXDP78 + pXDP54 | 33.5 |
| 69B | Spumaretrovirus | EFV | pXDP81 + pXDP57 | 3.3 |
| 70B | Spumaretrovirus | FFV | pXDP82 + pXDP58 | 3.5 |
| 87B | Spumaretrovirus | RHSFV | pXDP83 + pXDP59 | 21.3 |
| 80a | Spumaretrovirus | BFV | pXDP78 | 29.2 |
| 83a | Spumaretrovirus | EFV | pXDP81 | 4.7 |
| 84a | Spumaretrovirus | FFV | pXDP82 | 4.9 |
| 85a | Spumaretrovirus | RHSFV | pXDP83 | 4.1 |

TABLE 32

Results of Editing Assay for the second dilution (16.6 ul)

| XDP version | Genus/order | Virus | Plasmid numbers | Editing % |
|---|---|---|---|---|
| 66B | Spumaretrovirus | BFV | pXDP78 + pXDP54 | 1.8 |
| 69B | Spumaretrovirus | EFV | pXDP81 + pXDP57 | 0.7 |
| 70B | Spumaretrovirus | FFV | pXDP82 + pXDP58 | 0.6 |
| 87B | Spumaretrovirus | RHSFV | pXDP83 + pXDP59 | 9.3 |
| 80a | Spumaretrovirus | BFV | pXDP78 | 1.4 |
| 83a | Spumaretrovirus | EFV | pXDP81 | 0.4 |
| 84a | Spumaretrovirus | FFV | pXDP82 | 0.7 |
| 85a | Spumaretrovirus | RHSFV | pXDP83 | 0.7 |

Example 12: Non-Covalent Recruitment with RNA Binding—Gag-MS2

The purpose of these experiments was to evaluate the ability of an MS2-based non-covalent recruitment (NCR) system to improve the generation of XDP in packaging host cells where the CasX RNP is recruited into the XDPs by fusing MS2 coat proteins to the HIV Gag polyprotein and MS2 hairpin is incorporated into the guide RNA.

Methods:

All plasmids encoding CasX proteins had the CasX 491 variant protein.

RNA fold structures were generated with RNAfold web server and Varna java-based software.

Structural Plasmid Cloning

In order to generate the structural plasmids used below, pXDP1 was digested using EcoRI to remove the Gag-pol sequence. Between one and three fragments containing CasX variant, HIV-1, or MS2 CP components were amplified and cloned as described in Example 7, above. The resultant plasmids were sequenced using Sanger sequencing to ensure correct assembly.

Guide Plasmid Cloning

Figure 32:
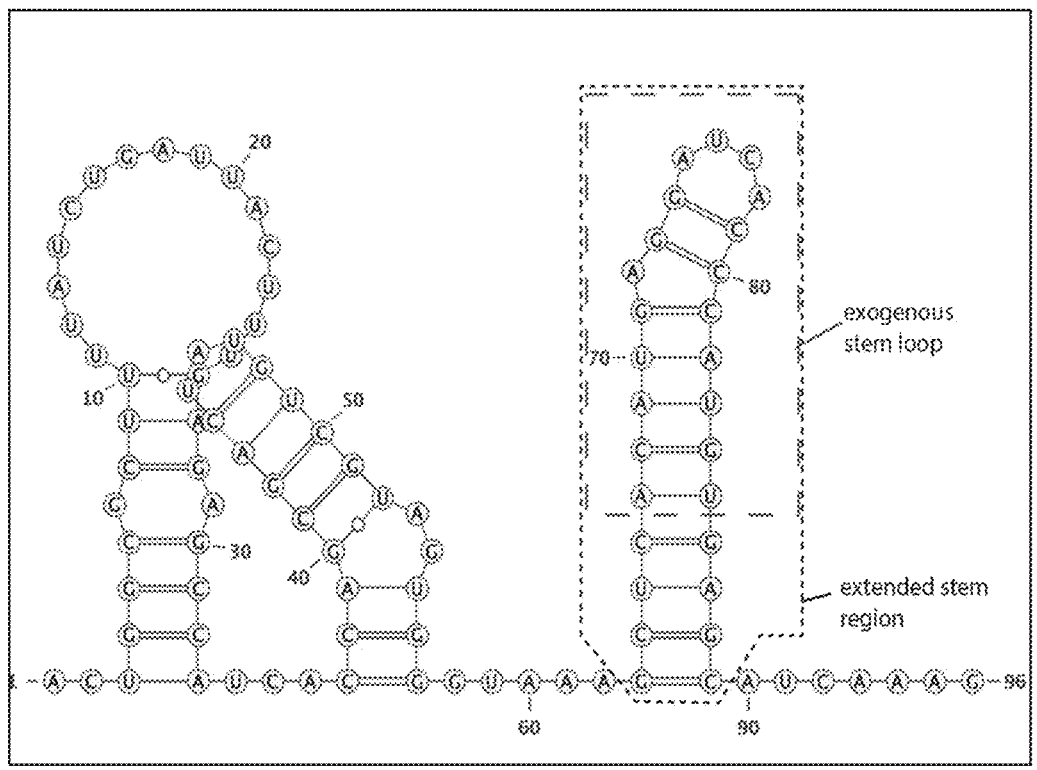
FIG. 32 is a schematic of the RNA secondary structures of guide RNA scaffold 188, as described in Example 12, Example 15, Example 16, and Example 17. The sequence in FIG. 32 is SEQ ID NO: 2249.
Figure 33:
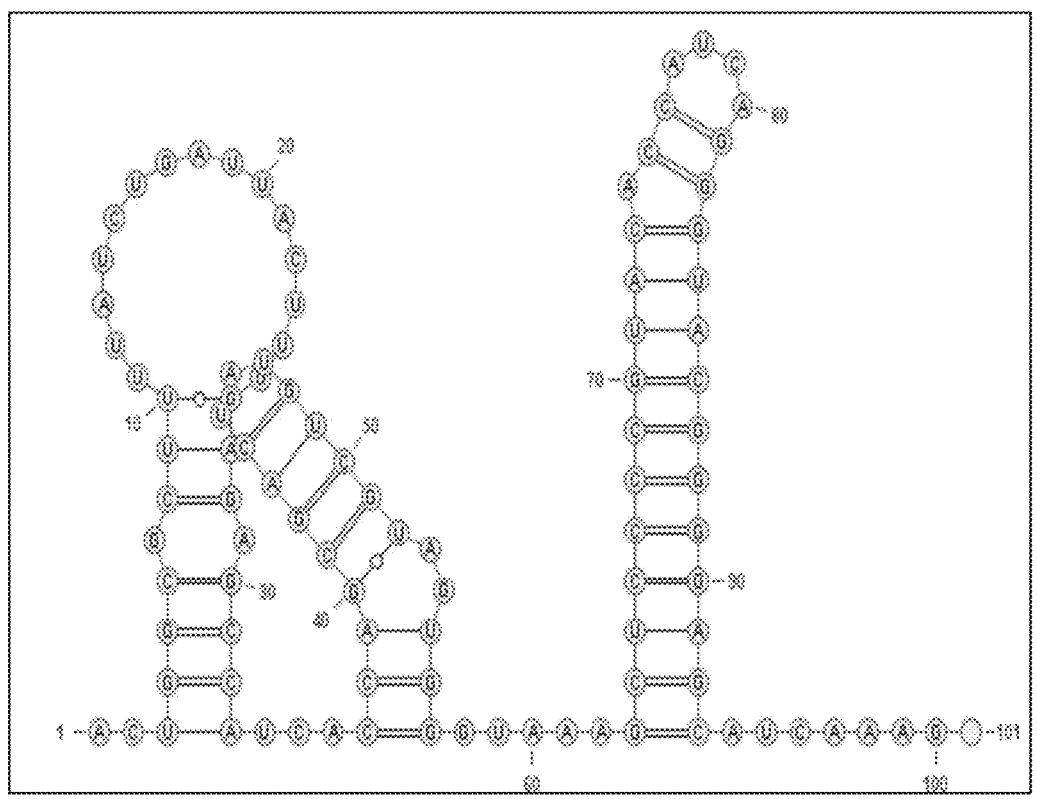
FIG. 33 is a schematic of the RNA secondary structures of guide RNA scaffold 228, as described in Example 12. The sequence in FIG. 33 is SEQ ID NO: 2374.

The tdTomato targeting guide plasmids used in these experiments were pSG50 (guide scaffold 188; FIG. 32) and pSG54 (guide scaffold 228; FIG. 33), which were cloned from pSG33 and pSG34, respectively. The mammalian expression backbone contained a cPPT, ampicillin resistance, and a colEI replication site and was amplified using primers with appropriate overlaps to accept the U6 promoter and guide RNA scaffold cassette. The backbone, pSG3, was digested using NdeI and XbaI. Synthetic DNA fragments corresponding to scaffold variants were amplified and cloned as described in Example 7, above. The resultant plasmids, pSG33 and pSG34, were sequenced using Sanger sequencing to ensure correct assembly.

Cloning tdTomato Spacer 12.7 into pSG3 and pSG14

To clone the targeting pSG50 and pSG54 plasmids from the non-targeting pSG33 and pSG34, the spacer 12.7 was cloned using the following protocol. The targeting spacer sequence DNA for the tdTomato targeting spacer 12.7 was ordered as single-stranded DNA (ssDNA) oligos (Integrated DNA Technologies) consisting of the targeting sequence (CTGCATTCTAGTTGTGGTTT, SEQ ID NO: 1018) and the reverse complement of this sequence. These two oligos were annealed together and cloned into a pSG plasmid with an alternate scaffold by Golden Gate assembly as described in Example 7, above. The resultant plasmids were sequenced using Sanger sequencing to ensure correct ligation.

pGP2 Glycoprotein Plasmid Cloning

Sequences encoding the VSV-G glycoprotein and the CMV promoter were amplified from pMD2.G (UC Berkeley) and cloned as described in Example 7, above. The backbone was taken from a kanamycin resistant plasmid and amplified and cloned using the same methods. Assembled products were transformed into chemically-competent Turbo Competent *E. coli* bacterial cells, plated on LB-Agar plates containing kanamycin and incubated at 37° C. The resultant plasmids in this 5 plasmid system (Gag-(−1)-PR, Gag-MS2, CasX, gRNA, and GP) were sequenced using Sanger sequencing to ensure correct assembly.

Cell Culture and Transfection

HEK293T Lenti-X cell culture was performed as described in Example 7, above. For transfection, the XDP structural plasmids (also encoding the CasX variants) of Table 35 were used in amounts ranging from 13 to 80.0 pg. Each transfection also received 13 µg of some pSG plasmid and 0.25 µg of pGP2. Polyethylenimine (PEI Max from Polyplus) was then added as described in Example 7, above. Plasmid ratios in Table 33 were used in all version 206 XDPs used in this assay, based on prior experimental data from other XDP versions.

TABLE 33

Plasmids and ratios used in XDP constructs

| XDP version 206 plasmids | Structural plasmid ratios |
|---|---|
| Gag-(−1)-PR* | 10% |
| Gag-MS2* | 45% |
| CasX* | 45% |

*transcript contains RRE and produces REV

Collection and Concentration

Media was aspirated from the plates 24 hours post-transfection and replaced with Optimem (Thermo Fisher). XDP-containing media was collected 72 hours post-transfection and filtered through a 0.45 µm PES filter. The supernatant was concentrated and purified via centrifugation.

Filtered supernatant was divided evenly into an appropriate number of centrifuge tubes or bottles and ⅕$^{th}$ of the supernatant volume of Sucrose Buffer (50 mM Tris-HCL, 100 mM NaCl, 10% Sucrose, pH 7.4) was underlaid using serological pipettes. The samples were centrifuged at 10,000×g, 4° C., in a swinging-bucket rotor for 4 hours with no brake. The supernatant was carefully removed and the pellet briefly dried by inverting the centrifuge vessels. Pellets were either resuspended in Storage Buffer (PBS+113 mM NaCl, 15% Trehalose dihydrate, pH 8 or an appropriate media by gentle trituration and vortexing. XDPs were resuspended in 300 µL of DMEM/F12 supplemented with glutamax, HEPES, non-essential amino acids, Pen/Strep, 2-mercaptoethanol, B-27 without vitamin A, and N2.

Resuspension and Transduction tdTomato neural progenitor cells were resuspended and transduced as described in Example 7, above. tdTomato fluorescence was measured using flow cytometry. The assays were run 2-3 times for each sample, with similar results.

Figure 31:
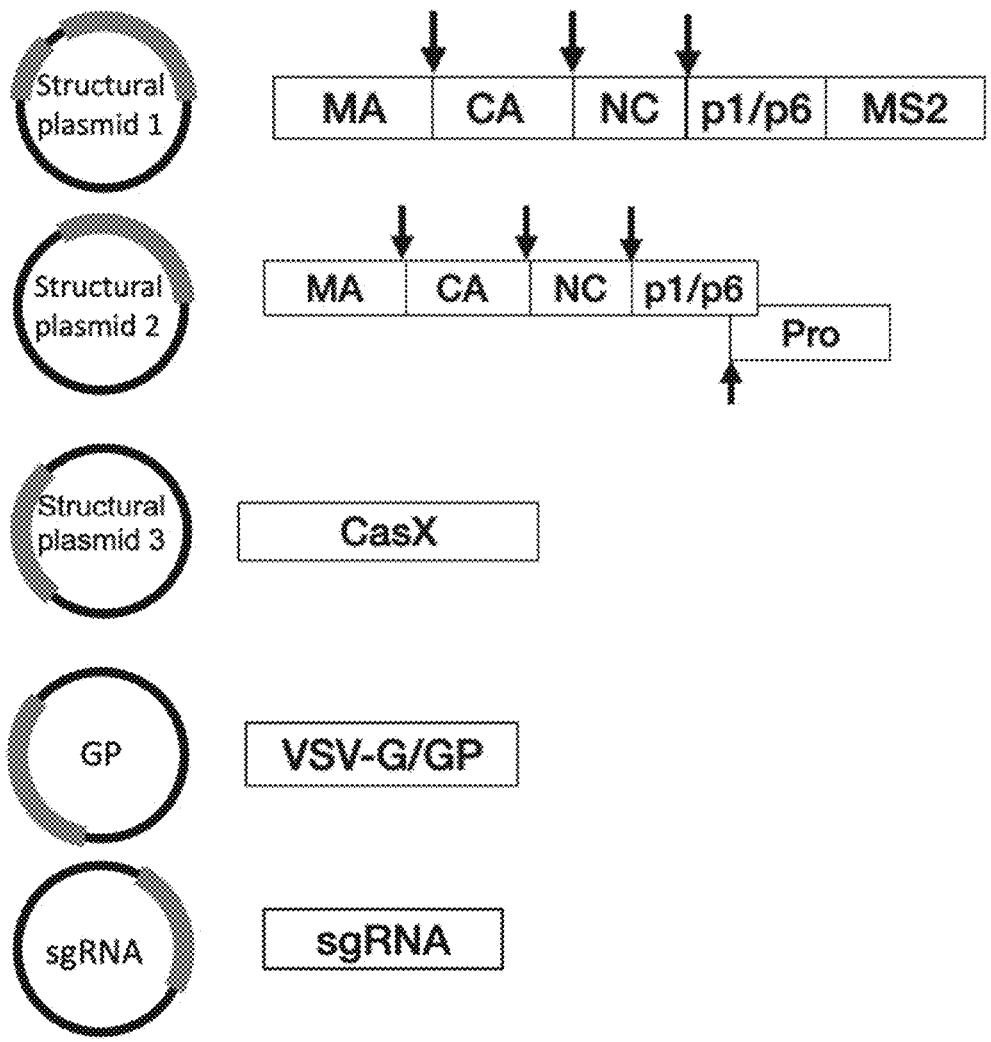
FIG. 31 depicts the plasmids utilized in the creation of XDP version 206, with protease cleavage sequence sites indicated by arrows, as described in Example 12.

Results:

The MS2 bacteriophage relies on the non-covalent affinity between its genomic RNA and the MS2 coat protein for the packaging of its genome in an icosahedral viral shell. The high-affinity element in the RNA genome is termed the MS2 hairpin, which binds to the coat protein with a kD of approximately 3e−9. Here, we have incorporated two high affinity variants of the MS2 hairpin into the extended stem of the guide scaffold 174, thereby introducing into the CasX:guide RNP an affinity for the MS2 coat protein. The resulting guide scaffolds 188 and 228 were tested in XDP version 168; a version that relies on a Gag-CasX fusion configuration and lacks the MS2 coat protein, while version 206 (FIG. 31) has the incorporated MS2 coat protein fused to Gag. Guides 188 and 228 performed similarly to guide scaffold 174 in total editing across all volumes tested, demonstrating that the insertion of the MS2 hairpin was benign to the function of the RNP. The sequences with the MS2 hairpin variant sequences of these scaffolds are ACATGAGGATCACCCATGT (SEQ ID NO: 1131) and CGTACACCATCAGGGTACG (SEQ ID NO: 1132), respectively.

Figure 34:
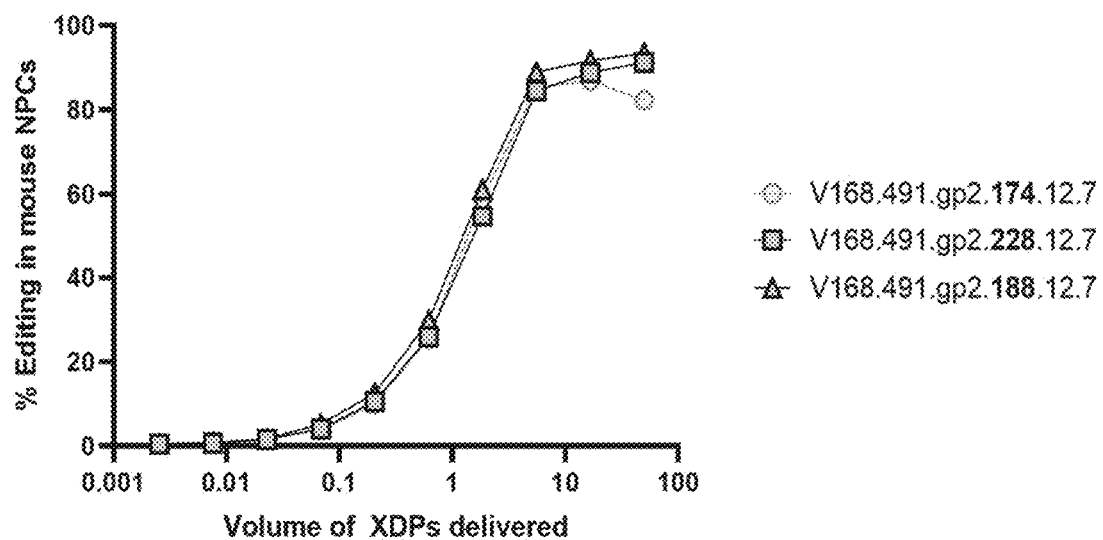
FIG. 34 shows the percent editing of tdTomato in NPCs by XDPs delivered by volume for guide scaffolds 174, 188, and 228 in XDP version 168, as described in Example 12.
Figure 35:
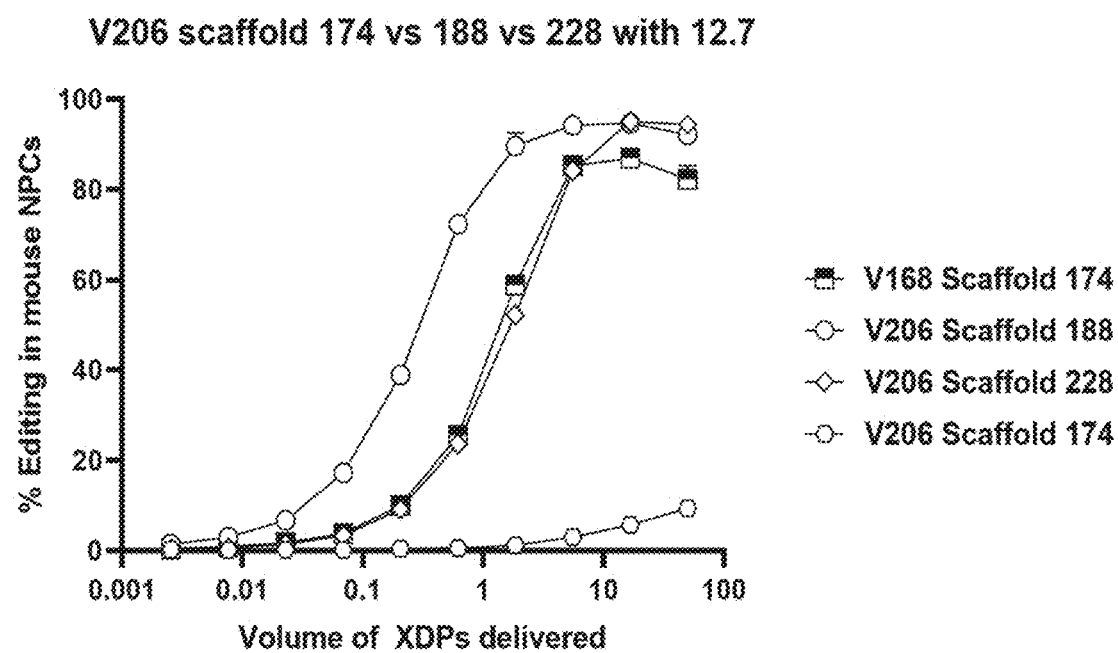
FIG. 35 shows the percent editing of tdTomato in NPCs by XDPs as delivered by volume (X axis) for guide scaffolds 174, 188, and 228 in XDP version 206 and guide scaffold 174 in XDP version 168 as positive control, as described in Example 12.

We tested MS2-based recruitment of these variant scaffolds in XDP version 206. This version is composed of the Gag-(−1)-PR, Gag-MS2, and CasX architectures. This version relies on orthogonal recruitment of CasX via the MS2 coat protein and MS2 hairpin system rather than a direct fusion between CasX and a recruiting protein. This is demonstrated in FIG. 34, where both scaffold 188 and 228 edit well in the tdTomato assay, in contrast to constructs with scaffold 174, which lacks the MS2 hairpin and edits poorly. Additionally, XDP version 206 with scaffold 188 edits better at the same dosage over XDP version 168 with scaffold 174 (see FIG. 35). At 0.6 µL of XDPs delivered, editing was ~70% with XDP version 206 with guide scaffold 188. In the same assay, —20% editing was achieved at the same treatment volume for XDP version 168 with guide scaffold 174 and version 206 with guide scaffold 228. These data suggests that XDP version 206 with scaffold 188 is 2-3× more potent than version 168 with scaffold 174. This increase in editing from version 168 to version 206 could be attributed to the lack of a direct fusion of Gag to CasX, causing less steric hindrance in particle formation. Furthermore, the similarity between guide scaffolds 188 and 228 in editing in version 168 suggests that the difference in potency in XDP version 206 is due to the MS2 hairpin's affinity for the coat protein.

The results suggest two possible mechanisms of recruitment of the CasX RNP to XDP particles in version 206. First, the CasX protein and scaffold RNA form the apoenzyme RNP in the cytoplasm of the producer cell. This RNP then binds the Gag-MS2 protein by interactions of the extended stem MS2 hairpin and the coat protein. The second possible mechanism is that the scaffold RNA first binds the MS2 coat protein and then forms the apoenzyme with the CasX protein. Collectively, the results demonstrate the utility of the incorporation of the MS2 system for the formation of more potent XDP particles with higher editing capabilities. Additionally, the MS2 coat protein has several point mutations that alter its affinity to its hairpin RNA. Usage of these variants in version 206 could result in higher potency variants. Fusing multiple coat proteins to the HIV Gag protein could further increase potency as well. Alternatively, there are also several RNA hairpin-non-covalent recruitment (NCR) protein combinations such as Qβ phage, GA phage, PP7 phage, or AN that could be used to replace MS2. Other protein RNA combinations from humans and retroviruses include the Iron Responsive Element-Iron Binding element, U1 hairpin II, retrovirus Tat-Tar system, Csy4, Pardaxin, tRNA or Psi-Nucleocapsid.

TABLE 34 sgRNA encoding sequences

| Plasmid number | Scaffold | Spacer | Full Encoding Sequence | SEQ ID NO | Encoding Hairpin sequence | SEQ ID NO |
|---|---|---|---|---|---|---|
| pSG0033 | 188 | NT | ACTGGCGCTTTTATCTGATTACTTT GAGAGCCATCACCAGCGACTATGTC GTAGTGGGTAAAGCTCACATGAGGA TCACCCATGTGAGCATCAAAGCGAG ACGTAATTACGTCTCG | 1135 | ACATGAGG ATCACCCA TGT | 1131 |

TABLE 34-continued sgRNA encoding sequences

| Plasmid number | Scaffold | Spacer | Full Encoding Sequence | SEQ ID NO | Encoding Hairpin sequence | SEQ ID NO |
|---|---|---|---|---|---|---|
| pSG0034 | 228 | NT | ACTGGCGCTTTTATCTGATTACTTT GAGAGCCATCACCAGCGACTATGTC GTAGTGGGTAAAGCTCCCCGTACAC CATCAGGGTACGGGGAGCATCAAAG CGAGACGTAATTACGTCTCG | 1134 | CGTACACC ATCAGGGT ACG | 1132 |
| pSG0035 | 229 | NT | ACTGGCGCTTTTATCTGATTACTTT GAGAGCCATCACCAGCGACTATGTC GTAGTGGGTAAAGCTCCCCGTACAC CATTAGGGTACGGGGAGCATCAAAG CGAGACGTAATTACGTCTCGTTTTT TTT | 35051 | CGTACACC ATTAGGGT ACG | 35052 |
| pSG50 | 188 | 12.7 | ACTGGCGCTTTTATCTGATTACTTT GAGAGCCATCACCAGCGACTATGTC GTAGTGGGTAAAGCTCACATGAGGA TCACCCATGTGAGCATCAAAGCGAG ACGTAATTACGTCTCG | 1135 | ACATGAGG ATCACCCA TGT | 1131 |
| pSG54 | 228 | 12.7 | ACTGGCGCTTTTATCTGATTACTTT GAGAGCCATCACCAGCGACTATGTC GTAGTGGGTAAAGCTCCCCGTACAC CATCAGGGTACGGGGAGCATCAAAG CGAGACGTAATTACGTCTCG | 1137 | CGTACACC ATCAGGGT ACG | 1132 |

TABLE 35

Architecture and glycoprotein sequences

| Plasmid number | Architecture | DNA Sequence (SEQ ID NO) |
|---|---|---|
| pXDP17 | Gag-CasX491-Hatag | 1138 |
| pXDP161* | Gag-(-1)-PR | 1139 |
| pXDP164* | Gag-MS2 | 1140 |
| pXDP165* | Gag-MS2-p1-p6-(-1)-PR | 1141 |
| pXDP166* | SV40NLS-CasX491-SV40 NLS | 1142 |

*backbone of plasmid expresses Rev

TABLE 36

Version and pseudotyping descriptions

| XDP version | Architectures and glycoproteins | Plasmid numbers | Rev expression |
|---|---|---|---|
| 168 | Gag-(-1)-PR Gag-CasX VSV-G | pXDP161 pXDP17 pGP2 | Yes |
| 206 | Gag-(-1)-PR Gag-MS2 CasX VSV-G | pXDP161 pXDP164 pXDP166 pGP2 | Yes |

Example 13: Non-Covalent Recruitment with RNA Binding—Partial Gag-MS2

The purpose of these experiments was to demonstrate the utility of a non-covalent recruitment (NCR) method for the incorporation of RNP into XDP using an MS2-based system where the RNP is recruited into the XDPs by fusing the MS2 coat protein (CP) to different proteins within an HIV Gag polyprotein in the XDP construct.

The MS2 packaging system consists of two major components; the phage coat protein and their cognate binding partner, which is a short hairpin stem loop structure. In this orthogonal phage RNA based recruitment system, the short hairpin stem loop structure is engineered into the sgRNA incorporated into the XDP. The encoding sequence for the phage coat protein is fused to either the encoding sequence for the Gag polyprotein (derived from any retroviruses) or to any other protein domains derived from the Gag polyprotein of any retroviral origin. This would enable the recruitment of the expressed CasX RNP into the XDP particle by the targeted interaction between the short hairpin stem loop structure engineered into the sgRNA complexed with the CasX as an RNP and the phage coat protein fused to the Gag polyprotein or any proteins derived from the Gag polyprotein. Here, we describe the generation of XDPs where the RNP is recruited into the XDPs by fusing the MS2 coat protein (CP) to different proteins within an HIV Gag polyprotein in the XDP construct.

Methods:

All plasmids containing CasX proteins encoded the CasX 491 variant protein. All XDPs were pseudotyped with 10% VSV-G (percentage of plasmid relative to the other plasmids utilized for the XDP construct). The guide RNA or spacer used in all of these experiments is 12.7 targeting the TdTomato locus. The scaffold used in all the MS2 constructs is 188 along with spacer 12.7. The scaffold used in control construct (V168) along with spacer 12.7 is 226. This scaffold has the RRE/RBE element described in other examples herein. RNA fold structures were generated with RNAfold web server and Varna java-based software.

Structural Plasmid Cloning

In order to generate the structural plasmid (pXDP17, pXDP161, 164 and 166), pXDP1 was digested using EcoRI to remove the Gag-pol sequence. Between one and three fragments containing CasX variant, HIV-1, or MS2 CP components were amplified and cloned as described in Example 7, above. The resultant plasmids were sequenced using Sanger sequencing to ensure correct assembly.

MS2 was placed either on the N- or the C-terminal of the Capsid (Version 263-pXDP276, Version 264-pXDP277, Version 265-pXDP278 and Version 266-pXDP279), with and without cleavage sites. MS2 was placed either on the N- or the C-terminal of the Nucleocapsid (Version 267-pXDP280, Version 268-pXDP281, Version 269-pXDP282 and Version 270-pXDP283), with and without cleavage sites. The sequences for these constructs are provided in Table 38. The designed constructs were synthesized as transgenes and purchased pre-cloned into pTWIST expression plasmids from Twist Biosciences. The resultant plasmids were sequenced using Sanger sequencing to ensure correct assembly.

Guide Plasmid Cloning

The guide plasmids used in these experiments were pSG50 and pSG17, encoding guide scaffold 188. To clone the targeting pSG50 and pSG17 we cloned the spacer 12.7 using the following protocol. The targeting spacer sequence DNA for the tdTomato targeting spacer 12.7 was ordered as single-stranded DNA (ssDNA) oligos (Integrated DNA Technologies) consisting of the targeting sequence (CTGCATTCTAGTTGTGGTTT, SEQ ID NO: 1018) and the reverse complement of this sequence. These two oligos were annealed together and cloned into a pSG plasmid with an alternate scaffold. This was done by Golden Gate assembly as described in Example 7, above. The resultant plasmids were sequenced using Sanger sequencing to ensure correct ligation. The guide plasmid used in all MS2 constructs is pSG50. The guide plasmid used in control construct (V168) is pSG517.

pGP2 Glycoprotein Plasmid Cloning

Sequences encoding the VSV-G glycoprotein and the CMV promoter were amplified from pMD2.G (UC Berkeley) and cloned as described in Example 7, above. The backbone was taken from a kanamycin resistant plasmid and amplified and cloned using the same methods. Assembled products were transformed into chemically-competent Turbo Competent E. coli bacterial cells, plated on LB-Agar plates containing kanamycin and incubated at 37° C. The resultant plasmids were sequenced using Sanger sequencing to ensure correct assembly.

Cell Culture and Transfection

HEK293T Lenti-X cell culture was performed as described in Example 7, above. For transfection, the XDP structural plasmids of Table 38 were used in amounts ranging from 13 to 80.0 pg. Each transfection also received 13 µg of pSG50 or pSG17 and 0.25 µg of pGP2. Polyethylenimine (PEI Max from Polyplus) was then added as described in Example 7.

Collection and Concentration

XDPs were collected and concentrated as described in Example 8, above.

Resuspension and Transduction tdTomato neural progenitor cells were resuspended and transduced as described in Example 8, above. tdTomato fluorescence was measured using flow cytometry. The assays were run 2-3 times for each sample, with similar results.

Figure 36:
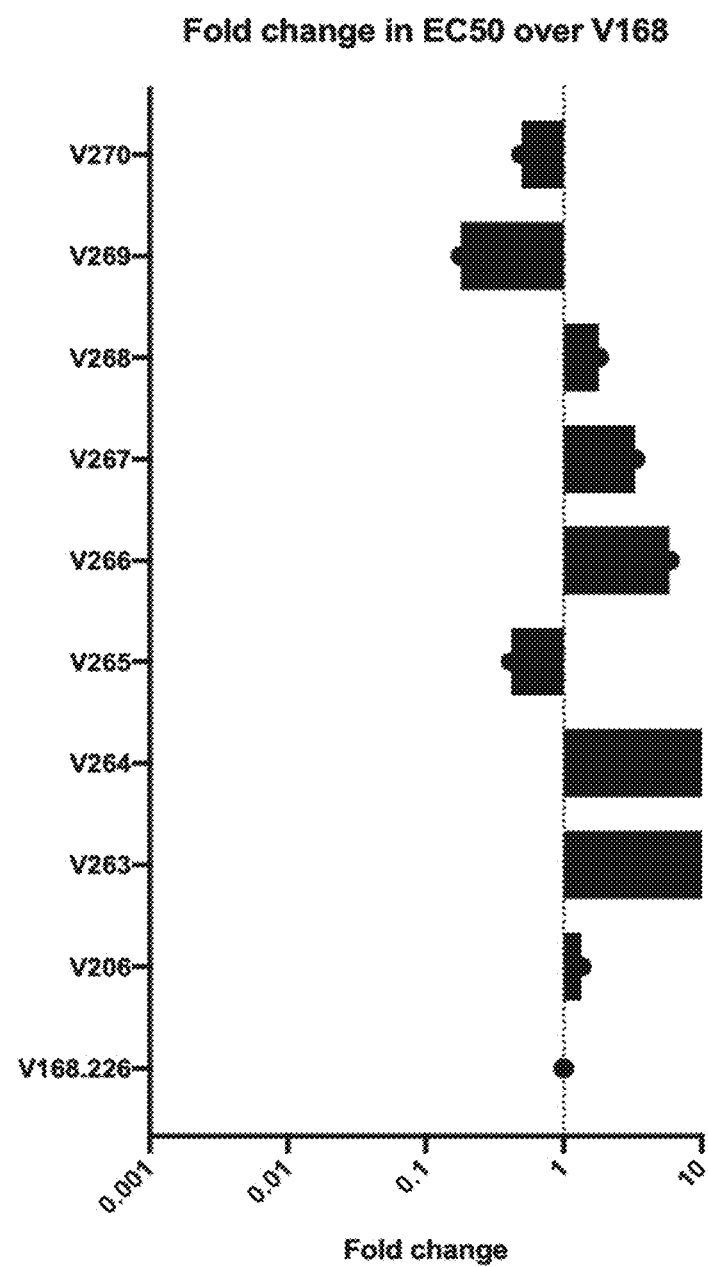
FIG. 36 is a bar chart depicting the fold-change in EC50 editing improvement of the indicated XDP versions (Y axis) relative to Version 168 (set to a value of 1.0), as described in Example 13. Editing of tdTomato was determined by analysis of fluorescence of treated NPCs.
Figure 37:
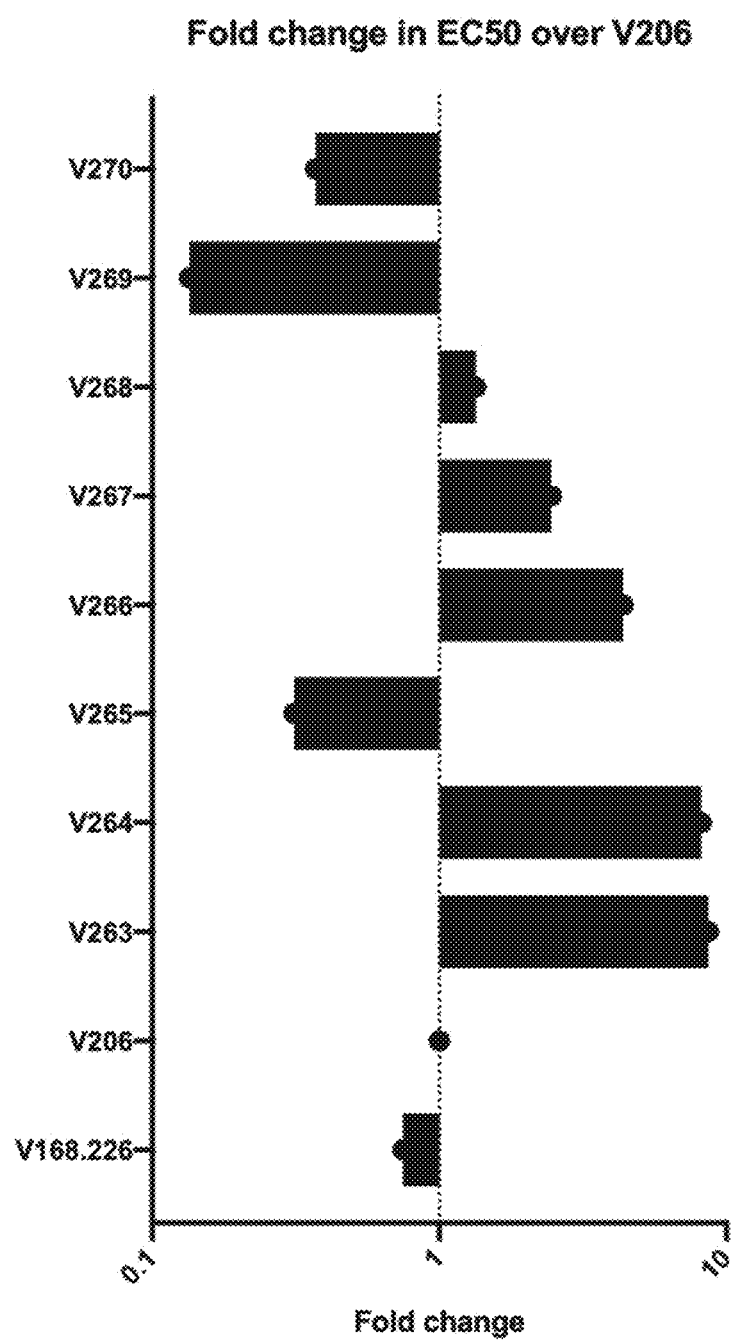
FIG. 37 is a bar chart depicting the fold-change in EC50 editing improvement of the indicated XDP versions (Y axis) relative to Version 206 (set to a value of 1.0), as described in Example 13. Editing of tdTomato was determined by analysis of fluorescence of treated NPCs.

Results:

Percent editing of the tdTomato target sequence in tdT NPCs are shown for all the constructs in FIG. 100 in terms of number of particles added and the volume of XDPs added (FIG. 101). Table 37 presents the results of percent editing of the dtTomato target sequence when 16.6 µl of the concentrated XDP prep was used to treat NPCs. The results show that it is feasible to fuse MS2 with or without a cleavage sequence to either the capsid or the nucleocapsid. The results indicate that fusing MS2 to the C-terminal of the capsid results in more potent XDP as compared to a fusion to the N-terminal. In addition, introduction of a cleavage site in between MS2 and CA on the C-terminal does improve potency as shown in FIG. 100. Fusing MS2 to the N- or C-terminal of nucleocapsid with and without a cleavage site may be superior to a capsid fusion, with a fusion to the N-terminal of NC being marginally better in terms of editing as shown in FIG. 101. The EC50 for the different constructs were calculated and plotted as shown in FIG. 102 and recapitulates the differences in potency described above. FIG. 36 depicts the fold improvement in EC50 over the base control V168 (CasX fused to full length HIV Gag-polyprotein) and it shows that V265, V269 and V270 show about 5 to 8-fold improvement in potency. FIG. 37 depicts the fold improvement in EC50 over the base control V206 (MS2 fused to full length HIV Gag-polyprotein and it shows that V265, V269 and V270 show about 6 to 9-fold improvement in terms of overall editing potency.

TABLE 37

Percent editing at the second dilution (16.6 µl)

| XDP version | Plasmid number | Configuration | % Editing |
|---|---|---|---|
| 168 | pXDP17 | MA-CA-NC-P1/P6-CasX | 92.6 |
| 206 | pXDP164 | MA-CA-NC-P1/P6-MS2 | 92.3 |
| 263 | pXDP276 | MA-CA-MS2-NC-P1/P6 | 85.5 |
| 264 | pXDP277 | MA-MS2-CA-NC-P1/P6 | 9.8 |
| 265 | pXDP278 | MA-CA-cleavage site-MS2-NC-P1/P6 | 75.6 |
| 266 | pXDP279 | MA-MS2-cleavage site-CA-NC-P1/P6 | 45 |
| 267 | pXDP280 | MA-CA-NC-MS2-P1/P6 | 90.1 |
| 268 | pXDP281 | MA-CA-NC-cleavage site-MS2-P1/P6 | 91.4 |
| 269 | pXDP282 | MA-CA-MS2-NC-P1/P6 | 91.6 |
| 270 | pXDP283 | MA-CA-MS2-cleavage site-NC-P1/P6 | 82.1 |

These results show that it is functionally feasible to fuse MS2 with or without a cleavage sequence to the capsid or the nucleocapsid derived from the HIV Gag polyprotein to create XDP that result in enhanced editing of the target nucleic acid. These results also show that it is possible to improve potency depending on the location within the Gag polyprotein (or its components) where the MS2 is fused. This enhanced architecture can be translated to proteins derived from the Gag polyproteins of Alpharetroviral, Betaretroviral, Gammaretroviral, Deltaretroviral, Epsilonretroviral, Lentiviral and Spumaretroviral origin, serving as an orthogonal recruitment mechanism for CasX or any other payload that can be coupled with a cognate short hairpin RNA element in an XDP or other particle-delivery system.

TABLE 38

Plasmid sequences

| XDP version | Plasmid number | SEQ ID NO of Encoding Sequence |
|---|---|---|
|  | pGP2 | 1003 |
|  | pSG50 | 1143 |
|  | pXDP161 | (see Table 35 for pXDP161 sequence) |
| 168 | pXDP17 | 1144 |
|  | pXDP166 | (see Table 35 for pXDP166 sequence) |
| 206 | pXDP164 | (see Table 35 for pXDP164 sequence) |
| 301 | pXPD276 | 1145 |
| 302 | pXPD277 | 1146 |
| 303 | pXPD278 | 1147 |
| 304 | pXPD279 | 1148 |
| 305 | pXPD280 | 1149 |
| 306 | pXPD281 | 1150 |

TABLE 38-continued

Plasmid sequences

| XDP version | Plasmid number | SEQ ID NO of Encoding Sequence |
|---|---|---|
| 307 | pXPD282 | 1151 |
| 308 | pXPD283 | 1152 |
|  | pSG17 | 1153 |

Example 14: Non-Covalent Recruitment with RNA Binding—Retro-MS2

The purpose of these experiments was to demonstrate the utility of a recruitment method for the incorporation of RNP into XDP using an MS2-based system and Gag polyproteins or components of Gag polyproteins derived from five genera of retroviruses, including Alpharetroviruses, Betaretroviruses, Gammaretroviruses, Deltaretroviruses and Lentiviruses.

Methods:

All plasmids containing CasX proteins encoded the CasX 491 protein. All XDPs were pseudotyped with 10% VSV-G (percentage of plasmid relative to the other plasmids utilized for the XDP construct). The guide RNA or spacer used in all of these experiments is 12.7 targeting the TdTomato locus. The scaffold used in all the MS2 constructs is 188, along with spacer 12.7. RNA fold structures were generated with RNAfold web server and Varna java-based software.

Structural Plasmid Cloning

MS2 was fused to the Gag-protease, Gag or partial Gag polyproteins derived from Alpharetroviruses (Versions 271, 272, 273), Betaretroviruses (Versions 277, 279), Gammaretroviruses (Versions 276, 278), Deltaretroviruses (Versions 274, 275) and Lentiviruses (Versions 280, 281, 282) with their respective species-specific cleavage sites. The sequences for these constructs are provided in Table 40. The designed constructs were synthesized as transgenes and purchased pre-cloned into pTWIST expression plasmids from Twist Biosciences. The resultant plasmids were sequenced using Sanger sequencing to ensure correct assembly.

Guide Plasmid Cloning

The guide plasmid used in these experiments was pSG50. To clone the targeting pSG50 we cloned the spacer 12.7 using the following protocol. The targeting spacer sequence DNA for the tdTomato targeting spacer 12.7 was ordered as single-stranded DNA (ssDNA) oligos consisting of the targeting sequence (CTGCATTCTAGTTGTGGTTT, SEQ ID NO: 1018) and the reverse complement of this sequence. These two oligos were annealed together and cloned into a pSG plasmid with an alternate scaffold by Golden Gate assembly as described in Example 7, above. The resultant plasmids were sequenced using Sanger sequencing to ensure correct ligation. pGP2 Glycoprotein plasmid cloning Sequences encoding the VSV-G glycoprotein and the CMV promoter were amplified from pMD2.G (obtained from UC Berkeley) and cloned as described in Example 7, above. The backbone was taken from a kanamycin resistant plasmid and amplified and cloned using the same methods. Assembled products were transformed into chemically-competent Turbo Competent *E. coli* bacterial cells, plated on LB-Agar plates containing kanamycin and incubated at 37° C. The resultant plasmids were sequenced using Sanger sequencing to ensure correct assembly.

Cell Culture and Transfection

HEK293T Lenti-X cell culture was performed as described in Example 7, above. For transfection, the XDP structural plasmids of Table 40 were used in amounts ranging from 13 to 80.0 µg. Each transfection also received 13 µg of p42.174.12.7 and 0.25 µg of pGP2. Polyethylenimine (PEI Max from Polyplus) was then added as described in Example 7.

Collection and Concentration

XDPs were collected and concentrated as described in Example 8, above.

Resuspension and Transduction tdTomato neural progenitor cells were resuspended and transduced as described in Example 12, above, and tdTomato fluorescence was measured using flow cytometry. The assays were run 2-3 times for each sample with similar results.

Results:

Percent editing of the dtTomato target sequence in tdT NPCs are shown for all the constructs in FIG. 103 across the dilution curve for the volume of XDPs added. Table 39 represents the percent editing of the dtTomato target sequence when 16.6 Œ µl of the concentrated XDP prep was used to treat NPCs. These results show that, as compared to our control XDP in this experiment, which is V206 (derived from HIV, lentivirus) which edited at 95% efficacy at the tdTomato locus when 16.6 µl of the concentrated XDP was used, V271 and V272, which are different architectural variants derived from ALV (Alpharetroviruses) showed editing efficacies ranging from 79 to 88%. V275 derived from HTLV1 (Deltaretroviruses), V279 derived from MPMV (Betaretroviruses) as well as V281 derived from EIAV (Lentivirus) showed successful editing ranging from 76.5, 61.6, to 48.7% at the tdT locus, respectively. Other XDPs such as V273 (derived from RSV, Alpharetroviruses), V274 (derived from BLV, Deltaretroviruses), V276 (derived from FLV, Gammaretroviruses), V277 (derived from MMTV, Betretroviruses), V278 (derived from MMLV, Gammaretroviruses), V280 (derived from EIAV, Lentivirus), V282 (derived from SIV, Lentivirus) showed above background editing at the tdT locus ranging from 10.6 to 4.03%. The variation in editing efficiencies observed between the different constructs may be due to the architectural differences between the retroviral families used. Editing differences between V280 (editing at 10.6%) as compared to V281 (editing at 48.7%) would be an example of this as both versions are derived from EIAV (Lentivirus) but differ in the architectural sequence. V280 has MS2 fused to Gag-pro polyprotein whereas V281 has MS2 fused to the MA-CA polyprotein.

TABLE 39

Percent editing at the second dilution (16.6 µl)

| XDP version | Plasmid number | Genus/order | Virus | Virus with configuration | % Editing |
|---|---|---|---|---|---|
| 206 | pXDP164 | Lentivirus | HIV | HIV Gag-MS2 | 95.1 |
| 271 | pXDP354 | Alpharetrovirus | ALV | ALV Gag-pro-MS2 | 88.7 |

TABLE 39-continued

Percent editing at the second dilution (16.6 μl)

| XDP version | Plasmid number | Genus/order | Virus | Virus with configuration | % Editing |
|---|---|---|---|---|---|
| 272 | pXDP355 | Alpharetrovirus | ALV | ALV Gag-MS2 | 79.1 |
| 273 | pXDP356 | Alpharetrovirus | RSV | RSV Gag-pro-MS2 | 5.05 |
| 274 | pXDP357 | Deltaretrovirus | BLV | BLV Gag-pro-MS2 | 6.63 |
| 275 | pXDP358 | Deltaretrovirus | HTLV1 | HTLV1 Nat Gag-pro-MS2 | 76.5 |
| 276 | pXDP359 | Gammaretrovirus | FLV | FLV Gag-pro-MS2 | 5.3 |
| 277 | pXDP360 | Betaretrovirus | MMTV | MMTV Gag-pro-MS2 | 4.03 |
| 278 | pXDP361 | Gammaretrovirus | MMLV | MMLV Gag-pro-MS2 | 5.03 |
| 279 | pXDP362 | Betaretrovirus | MPMV | MPMV Gag-pro-MS2 | 61.6 |
| 280 | pXDP363 | Lentivirus | EIAV | EIAV Gag-pro-MS2 | 10.6 |
| 281 | pXDP364 | Lentivirus | EIAV | EIAV MA-CA-MS2 | 48.7 |
| 282 | pXDP365 | Lentivirus | SIV | SIV Gag-pro-MS2 | 9.05 |

Overall, these results show that it is functionally feasible to fuse MS2 with the Gag-protease, Gag or partial Gag polyproteins of diverse retroviral origin that include Alpharetroviruses, Betaretroviruses, Gammaretroviruses, Deltaretroviruses and Lentiviruses to create XDP that result in editing of the target nucleic acid. We believe that supplementing these versions with another plasmid that encodes for the respective Gag-protease or Gag polyprotein could possibly further augment editing functions. Additionally, it is likely that MS2 functionality would be maintained or improved if MS2 was fused to just the Gag polyproteins of Alpharetroviruses, Betaretroviruses, Gammaretroviruses, Deltaretroviruses and Lentiviruses and then supplemented with the Gag-protease polyprotein on another plasmid in the XDP system to aid cleavage of the polyprotein. Given the differences in editing potencies observed depending on the architectural variant of the viral polyprotein that is used to fuse MS2 to, the editing potencies of the MS2 based system may be further enhanced by fusing MS2 to different proteins (matrix or capsid) or different combinations of proteins (MA-CA, MA-CA-NC, etc.) that constitute the Gag polyprotein across the different retroviral families. We have shown the utility of this approach with the EIAV derived XPDs. This approach could also translate to the Gag and Gag-pro polyproteins of Spumaretroviruses and serve as an orthogonal recruitment mechanism for CasX or any other payload that can be coupled with a cognate short hairpin RNA element in an XDP or other particle-delivery system.

TABLE 40

Plasmid sequences

| XDP version | Plasmid number | SEQ ID NO of DNA Encoding Sequence |
|---|---|---|
|  | pGP2 | 1003 |
|  | pSG50 | 1154 |
|  | pXDP166 | (see Table 35 for pXDP166 sequence) |
| 206 | pXDP161 | (see Table 35 for pXDP161 sequence) |
| 206 | pXDP164 | (see Table 35 for pXDP164 sequence) |
| 271 | pXDP354 | 1155 |
| 272 | pXDP355 | 1156 |
| 273 | pXDP356 | 1157 |
| 274 | pXDP357 | 1158 |
| 275 | pXDP358 | 1159 |
| 276 | pXDP359 | 1160 |
| 277 | pXDP360 | 1161 |
| 278 | pXDP361 | 1162 |
| 279 | pXDP362 | 1163 |
| 280 | pXDP363 | 1164 |
| 281 | pXDP364 | 1165 |
| 282 | pXDP365 | 1166 |

Example 15: Non-Covalent Recruitment with MS2 Variants

Experiments were conducted to evaluate the ability of an MS2-based recruitment system using MS2 variants having altered affinities to the MS2 hairpin in order to improve the generation of XDP in packaging host cells.

Methods:

All plasmids encoding CasX proteins had the CasX 491 variant protein. All XDPs contained sgRNAs with scaffold 188 (see FIG. 32) and spacer 12.7.

Structural Plasmid Cloning

In order to generate the structural plasmids, listed below, pXDP1 was digested using EcoRI to remove the Gag-pol sequence. Between one and three fragments encoding CasX variant, HIV-1, or MS2 CP components were amplified and cloned as described in Example 7, above. The resultant plasmids were sequenced using Sanger sequencing to ensure correct assembly.

Guide Plasmid Cloning

The tdTomato targeting guide plasmid used in these experiments was pSG50 (guide scaffold 188), which was cloned from pSG33. The mammalian expression backbone contained a cPPT, ampicillin resistance, and a colEI replication site and was amplified using primers with appropriate overlaps to accept the U6 promoter and guide RNA scaffold cassette. The backbone, pSG3, was digested using NdeI and XbaI. Synthetic DNA fragments corresponding to novel scaffolds were amplified and cloned as described in Example 7, above. The resultant plasmid, pSG33, was sequenced using Sanger sequencing to ensure correct assembly.

Cloning tdTomato Spacer 12.7 into pSG33

To clone the targeting pSG50 plasmid from the non-targeting pSG33, we cloned the spacer 12.7 using the following protocol. The targeting spacer sequence DNA for the tdTomato targeting spacer 12.7 was ordered as single-stranded DNA (ssDNA) oligos (Integrated DNA Technologies) consisting of the targeting sequence (CTGCAT-TCTAGTTGTGGTTT, SEQ ID NO: 1018) and the reverse complement of this sequence. These two oligos were annealed together and cloned into a pSG plasmid with an alternate scaffold by Golden Gate assembly, as described in Example 7, above. The resultant plasmid was sequenced using Sanger sequencing to ensure correct ligation (see Table 42).

pGP2 Glycoprotein Plasmid Cloning

Sequences encoding the VSV-G glycoprotein and the CMV promoter were amplified from pMD2.G (UC Berkeley) and cloned as described in Example 7, above. The backbone was taken from a kanamycin resistant plasmid and amplified and cloned using the same methods. Assembled products were transformed into chemically-competent Turbo Competent E. coli bacterial cells, plated on LB-Agar plates containing kanamycin and incubated at 37° C. The resultant plasmids were sequenced using Sanger sequencing to ensure correct assembly. Table 43 lists the plasmid structural and glycoprotein plasmid components.

Cell Culture and Transfection

HEK293T Lenti-X cell culture was performed as described in Example 7, above. For transfection, the XDP structural plasmids (also encoding the CasX variants) of Table 43 were used in amounts ranging from 13 to 80.0 pg. Each transfection also received 13 µg of pSG50 and 0.25 of pGP2. Polyethylenimine (PEI Max from Polyplus) was then added as described in Example 7. Plasmid ratios in Table 41 were used in all Version 206 XDPs used in this assay and are based on prior data from other XDP versions.

TABLE 41

Construct plasmids and ratios of plasmids used

| XDP version 206 plasmids | Structural plasmid ratios |
|---|---|
| Gag-(-l)-PR* | 10% |
| Gag-MS2* | 45% |
| CasX* | 45% |

*transcript contains RRE and produces REV

Collection and Concentration

XDPs were collected and concentrated as described in Example 8, above.

Resuspension and Transduction tdTomato neural progenitor cells were resuspended and transduced as described in Example 7, above, and tdTomato fluorescence was measured using flow cytometry. The assays were run 2-3 times for each sample, with similar results.

TABLE 42 sgRNA and hairpin encoding sequences (DNA)

| Plasmid number | Guide scaffold | Spacer | DNA Sequence | SEQ ID NO | Hairpin Encoding Sequence | SEQ ID NO |
|---|---|---|---|---|---|---|
| pSG0033 | 188 | NT | ACTGGCGC TTTTATC TGATTAC TTTGAGA GCCATCA CCAGCGA CTATGTC GTAGTGG GTAAAGC | 1135 | ACATGAGG ATCACCCA TGT | 1131 |

TABLE 42-continued sgRNA and hairpin encoding sequences (DNA)

| Plasmid number | Guide scaffold | Spacer | DNA Sequence | SEQ ID NO | Hairpin Encoding Sequence | SEQ ID NO |
|---|---|---|---|---|---|---|
| | | | TCACATG AGGATCA CCCATGT GAGCATC AAAGCGA GACGTAA TTACGTC TCG | | | |
| pSG50 | 188 | 12.7 | ACTGGCG CTTTTAT CTGATTA CTTTGAG AGCCATC ACCAGCG ACTATGT CGTAGTG GGTAAAG CTCACAT GAGGATC ACCCATG TGAGCAT CAAAGCG AGACGTA ATTACGT CTCG | 1135 | ACATGAGG ATCACCCA TGT | 1131 |

TABLE 43

XDP Component Architecture and glycoprotein sequences

| Plasmid number | Architecture | SEQ ID NO of DNA Sequence |
|---|---|---|
| pGP2 | VSV-G | 1003 |
| pXDP161 | Gag-(-1)-PR | (see Table 35 for pXDP161 sequence) |
| pXDP164 | Gag-MS2 | (see Table 35 for pXDP164 sequence) |
| pXDP165 | Gag-MS2-p1-p6-(-1)-PR | (see Table 35 for pXDP165 sequence) |
| pXDP166 | SV40NLS-CasX491-SV40 NLS | (see Table 35 for pXDP166 sequence) |
| pXDP321 | Gag-MS2 (V29I) | 1167 |
| pXDP335 | Gag-MS2(K43R) | 1168 |
| pXDP336 | Gag-MS2(K66R) | 1169 |
| pXDP337 | Gag-MS2(N55R) | 1170 |
| pXDP338 | Gag-MS2(N87S) | 1171 |
| pXDP339 | Gag-MS2(T59A | 1172 |
| pXDP340 | Gag-MS2(dInc) | 1173 |
| pXDP353 | Gag-MS2(N55K) | 1174 |

Results:

In all, wild-type and 5 different MS2 variants were tested, as well as one dimerization-incompetent variant. These variants were tested in the same Gag-MS2 system as previous examples specified and this configuration is depicted in FIG. 32. To test these variants, pXDP164, which encodes the wild type Gag-MS2 in XDP version 206, was replaced with either pXDP321, pXDP335, pXDP336, pXDP337, pXDP338, pXDP339, or pXDP340. These MS2 variants had affinity kD's ranging from 1.2e−7 M to 4e−10 M, with the wild type version being 3e−9 M (a lower kD value indicates greater affinity between the MS2 hairpin and coat protein).

Figure 38:
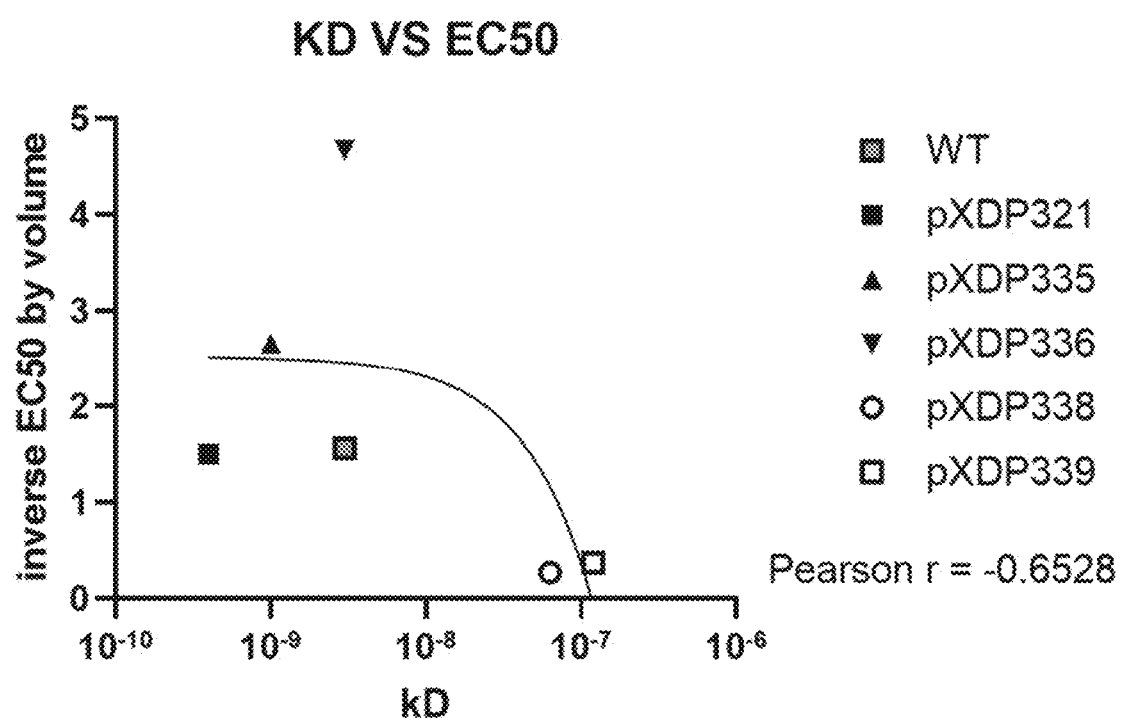
FIG. 38 is a graph of the kD of 5 different XDPs with MS2 coat protein variants and the wild type variant (indicated on the Y axis) plotted against the inverse EC50 by volume of XDPs delivered, as described in Example 15. The line was generated by linear regression of the points on the graph (Pearson's R=−0.6528).
Figure 39:
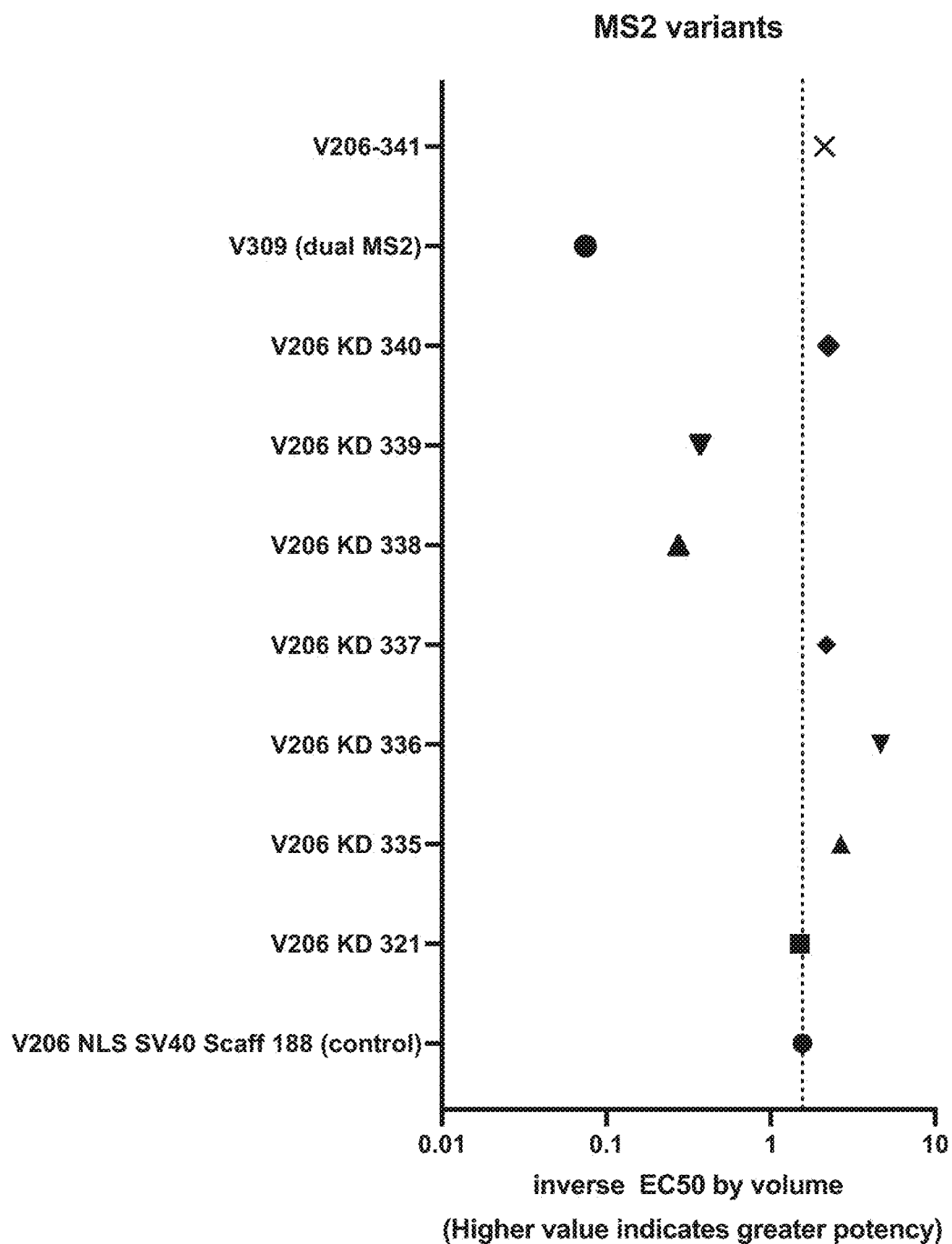
FIG. 39 is a graph of the inverse EC50s of 9 different MS2 coat protein variants and Version 206 with guide scaffold 188 without the MS2 (the latter value indicated by the dotted line), as described in Example 15.

Results of the assays showed that the XDP with MS2 having lower kD variants tended to perform with better editing than higher kDs (see Table 44) with a gRNA having a single MS2 hairpin (gRNA 188). The data were analyzed with a correlation analysis between the kD of the MS2 coat protein and the inverse of the EC50 (by volume of XDP introduced into assay); a measure of potency that increases with more potent XDP constructs. This resulted in an r value of −0.625 as seen in FIG. 38, demonstrating that incorporation of MS2 with lower kDs correlated with resultant increased editing potency. The results support that by altering the binding affinity of the RNA hairpin and NCR protein, we can effectively modulate the potency of XDPs, thereby improving the XDP constructs. The approach may be similarly used with other RNA binding proteins, such as Qβ phage, GA phage, PP7 phage, or A N for engineering more potent XDPs.

TABLE 44

MS2 variants

| Plasmid number | Mutation in MS2 | Affinity | Inverse EC50 by volume |
| --- | --- | --- | --- |
| pXDP164 | WT | WT | 1.6 |
| pXDP321 | V29I | kD: 4e−10M | 1.5 |
| pXDP335 | K43R | kD: 1e−9M | 2.7 |
| pXDP336 | K66R | kD: 3e−9M | 4.7 |
| pXDP337 | N55R | unknown | 2.2 |
| pXDP338 | N87S | kD: 6.3e−8M | 0.3 |
| pXDP339 | T59A | kD: 1.2e−7M | 0.4 |
| pXDP340 | V68 V80 dine | Dimerization incompetent | 2.2 |

TABLE 45

XDP Version and pseudotyping descriptions

| XDP version | Architectures and glycoproteins | Plasmid numbers | Rev expression |
| --- | --- | --- | --- |
| 206 | Gag-(-l)-PR | pXDP161 | Yes |
|  | Gag-MS2 | pXDP164 |  |
|  | CasX | pXDP166 |  |
|  | VSV-G | pGP2 |  |

Example 16: Evaluation of Non-Covalent Recruitment (NCR) Systems with RNA Binding Proteins Linked to Gag The purpose of these experiments was to evaluate the ability of various non-covalent recruitment (NCR) proteins linked to HIV Gag polyprotein and their cognate binding partner hairpin structures integrated into the guide RNA scaffolds in order to improve the generation of XDP in packaging host cells.

Methods:

The experiments described in this example were conducted in the XDP version 206 construct configuration, with various NCR proteins fused to Gag in place of the MS2 coat protein. All XDPs were pseudotyped with 10% VSV-G (percentage of plasmid relative to the other plasmids utilized for the XDP construct). RNA fold structures were generated with RNAfold web server and Varna java-based software Structural Plasmid Cloning In order to generate the structural plasmids used to make the XDP, pXDP1 was digested using EcoRI to remove the Gag-pol sequence. Between one and three fragments containing CasX, HIV-1, retrovirus Tat, IRP1, IRP2, truncated U1A, U1A, phage Qβ coat protein, phage GA coat protein, phage ΛN coat protein, or truncated phage ΛN coat protein components were amplified using In Fusion primers with 15-20 base pair overlaps and Kapa HiFi DNA polymerase according to the manufacturer's protocols. The fragments were purified by gel extraction from a 1% agarose gel using Zymoclean Gel DNA Recovery Kit according to the manufacturer's protocol. These fragments were cloned into plasmid backbones as described in Example 7, above. The resultant plasmids were sequenced using Sanger sequencing to ensure correct assembly.

Guide Plasmid Cloning

The guide plasmids modified in these experiments were pSG50, encoding guide scaffold 188 (see FIG. 32). The non-targeting guide plasmids used in these experiments were pSG82 to pSG88, encoding guide scaffold 188. The mammalian expression backbone had a cPPT, ampicillin resistance, and a colEI replication site and was amplified using primers with appropriate overlaps to accept the U6 promoter and guide RNA scaffold cassette. Fragments containing the BoxB hairpin, retrovirus Tar, Iron Responsive Element, U1A hpII, phage Qβ hairpin, phage GA hairpin, phage ΛN hairpin, or phage PP7 hairpin were amplified and cloned as described in Example 12, above. The resultant plasmids were sequenced using Sanger sequencing to ensure correct assembly. The targeting spacer sequence DNA for the tdTomato targeting spacer 12.7 was ordered as single-stranded DNA (ssDNA) oligos (Integrated DNA Technologies) consisting of the targeting sequence (CTGCAT-TCTAGTTGTGGTTT, SEQ ID NO: 1018) and the reverse complement of this sequence. These two oligos were annealed together and cloned into pSG33 and pSG34 by Golden Gate assembly as described in Example 7, above. The resultant plasmids were sequenced using Sanger sequencing to ensure correct ligation.

pGP2 Glycoprotein Plasmid Cloning

Sequences encoding the VSV-G glycoprotein and the CMV promoter were amplified and cloned as described in Example 7, above. The resultant plasmids were sequenced using Sanger sequencing to ensure correct assembly.

Cell Culture and Transfection

HEK293T Lenti-X cell culture was performed as described in Example 7, above. For transfection, the XDP structural plasmids (also encoding the CasX variants) of Table 46 were used in amounts ranging from 13 to 80.0 pg. Each transfection will also receive 13 μg of a pSG plasmid and 0.25 μg of pGP2. Polyethylenimine (PEI Max from Polyplus) was then added as described in Example 7.

Collection and Concentration

XDPs were collected and concentrated as described in Example 8, above.

Resuspension and Transduction tdTomato neural progenitor cells were resuspended and transduced as described in Example 7, above, and tdTomato fluorescence was measured using flow cytometry. The assays were run 2-3 times for each sample with similar results.

Results

The CasX scaffold extended stem region is highly modifiable. The stem loop protrudes out from the RNP, and so additions to this region have little effect on RNP formation and potency, as seen in other experiments described herein. This feature was used to add on one of several different RNA hairpins to modify CasX affinity to different RNA binding proteins. Table 46 shows the sequences of the Gag-NCR protein plasmids and their complementary sgRNAs with non-targeting spacers that were employed to create the versions.

It was expected that inclusion of these NCR proteins into the constructs will likely yield more potent XDP configurations as we have previously demonstrated that different kDs of NCR proteins, such as MS2, can modify the potency of XDPs. There is a large variety of kDs and sizes across these NCR proteins.

Figure 40:
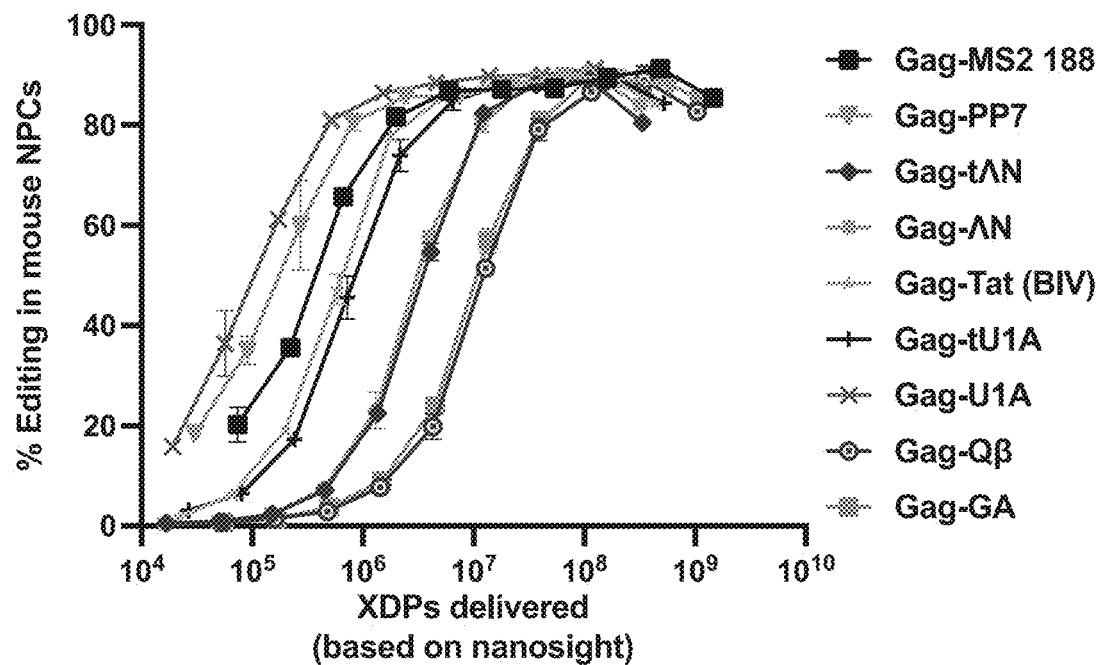
FIG. 40 shows the results of percentage editing in mouse tdTomato NPCs with XDPs containing various non-covalent recruitment (NCR) systems, as described in Example 16.
Figure 41:
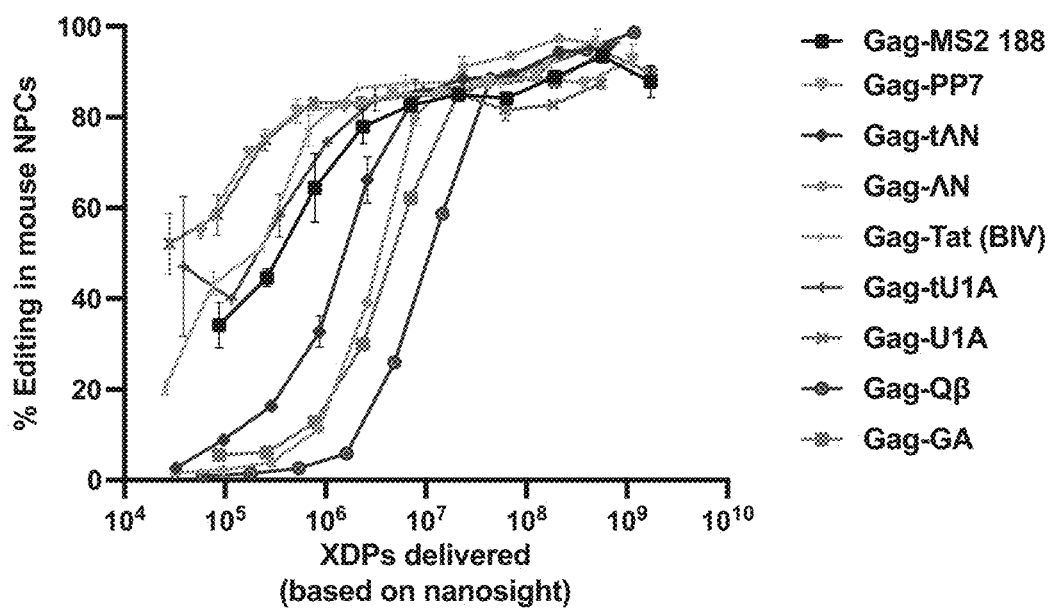
FIG. 41 shows the results of percentage editing in mouse tdTomato NPCs with XDPs containing various NCR systems, as described in Example 16.
Figure 42:
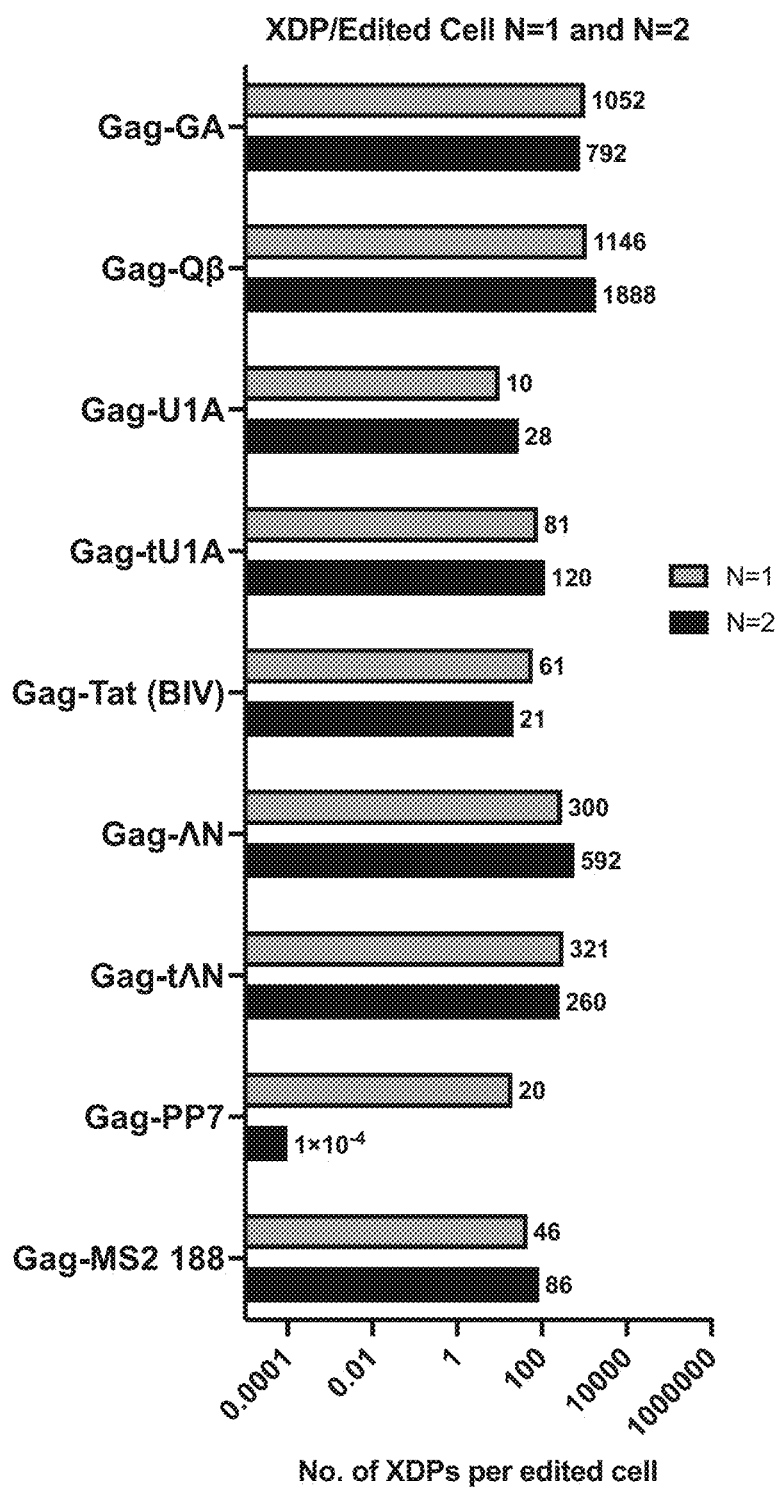
FIG. 42 is a bar chart showing the number of XDPs containing various NCR systems per edited mouse tdTomato NPC, as described in Example 16.
Figure 43:
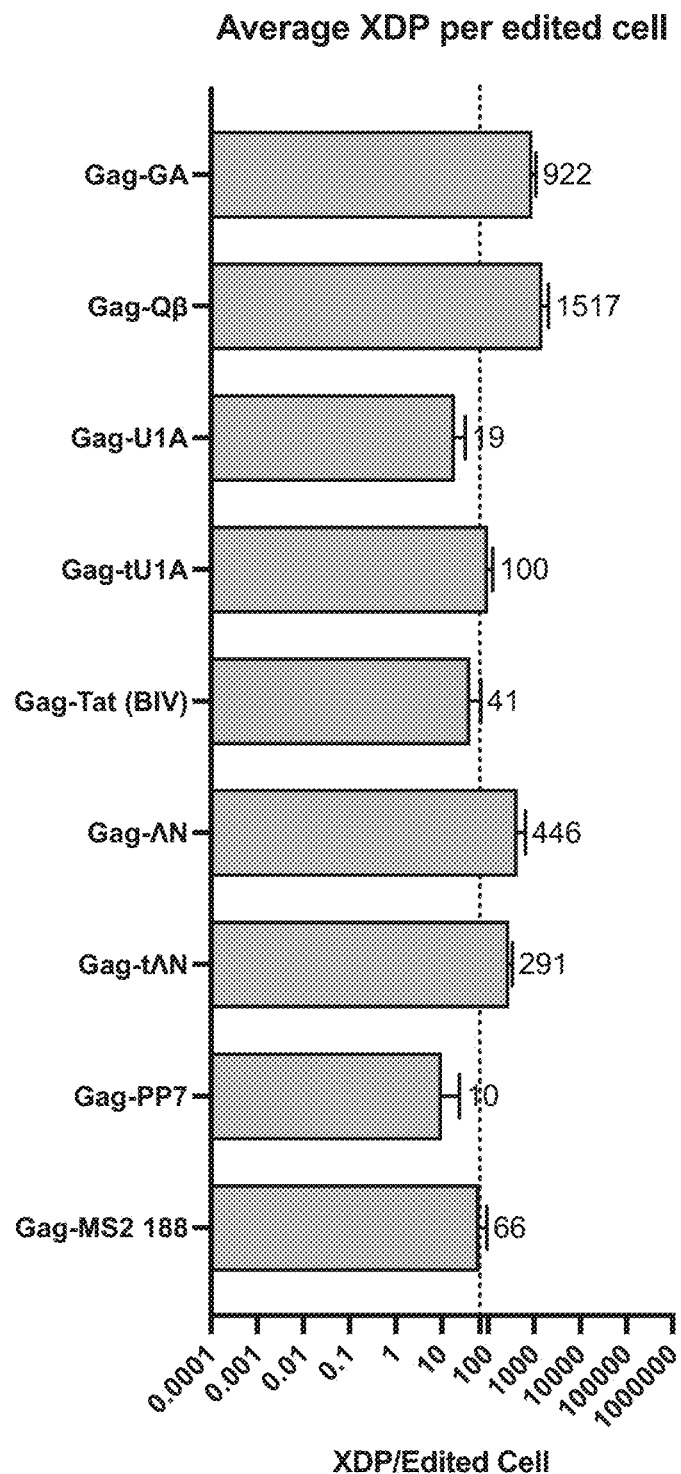
FIG. 43 is a bar chart showing the average number of XDPs containing various NCR systems per edited tdTomato NPC, as described in Example 16.

As shown in FIGS. 40-41, XDPs with the MS2, PP7, Tat, or U1A NCR systems produced the highest levels of editing in the mouse tdTomato NPCs. Indeed, XDPs with the Tat or U1A NCR systems produced higher levels of editing than XDPs with the MS2 NCR system. Both Tat and U1A NCR systems are monomeric in nature. Therefore, the fact that both Tat and U1A NCR systems produced higher levels of editing suggests that MS2 dimerization has a detrimental effect on XDP architecture formation. It is anticipated that the relatively small size of the Tat protein could make it amenable to stacking (i.e., adding multiple Tat binding sites), which could enable better recruitment and packaging of the CasX RNP.

In addition, it is anticipated that the location of the NCR protein in the Gag polyprotein or the viral protein used can both be modified, and enhanced guide RNA scaffolds could lead to further improvements in potency.

TABLE 46

Gag-NCR and guide scaffold sequences-scaffold 174

| NCR protein | Architecture | Plasmid number | GAG-Protein Encoding Sequence SEQ ID NO | Hairpin encoding sequence | SEQ ID NO | Scaffold 174 + Hairpin Encoding Sequence | SEQ ID NO |
|---|---|---|---|---|---|---|---|
| A N-just RNA binding site | Gag-tAN | pXDP366 | 1175 | GCCCTGAAGAA GGGC | 1185 | ACTGGCGCTTTTATCT GATTACTTTGAGAGCC ATCACCAGCGACTATG TCGTAGTGGGTAAAGC TGCACGCCCTGAAGAA GGGCGTGCAGCATCAA | 1192 |
| A N-full anti termination protein N | Gag-AN | pXDP367 | 1176 | | | | |
| PP7 | Gag-PP7 | pXDP342 | 1177 | AAGGAGTTTAT ATGGAAACCCT T | 1186 | ACTGGCGCTTTTATCT gATTACTTTGAGAGCC ATCACCAGCGACTATG TCGTAgTGGGTAAAGC tgcacAAGGAGTTTAT ATGGAAACCCTTgtgc AGCATCAAAG | 1193 |
| TAT/Tar | Gag-Tat | pXDP368 | 1178 | GGCTCGTGTAG CTCATTAGCTC CGAGCC | 1187 | ACTGGCGCTTTTATCT gATTACTTTGAGAGCC ATCACCAGCGACTATG TCGTAgTGGGTAAAGC tgcacGGCTCGTGTAG CTCATTAGCTCCGAGC CgtgcAGCATCAAAG | 1194 |
| IRP | Gag-IRP1 | pXDP369 | 1179 | ccgtgTGCatc cgCAGTGtcgg atCcacgg | 1188 | ACTGGCGCTTTTATCT gATTACTTTGAGAGCC ATCACCAGCGACTATG TCGTAgTGGGTAAAGC tgcaccgtgTGCatc cgCAGTGtcggatCca cgggtgcAGCATCAAA G | 1195 |
| | Gag-IRP2 | pXDP370 | 1180 | ccgtgTGCatc cgCAGTGtcgg atCcacgg | 1188 | ACTGGCGCTTTTATCT gATTACTTTGAGAGCC ATCACCAGCGACTATG TCGTAgTGGGTAAAGC tgcaccgtgTGCatc cgCAGTGtcggatCca cgggtgcAGCATCAAA G | 1196 |
| U1A-Truncated | Gag-tU1A | pXDP371 | 1181 | GGAATCCATTG CACTCCGGATT TCACTAG | 1189 | ACTGGCGCTTTTATCT GATTACTTTGAGAGCC ATCACCAGCGACTATG TCGTAGTGGGTAAAGC TGCACAGCTATCCATT GCACTCCGGATAGCTG TGCAGCATCAAAG | 1197 |
| U1A-Full | Gag-U1A | pXDP372 | 1182 | GGAATCCATTG CACTCCGGATT TCACTAG | 1189 | ACTGGCGCTTTTATCT GATTACTTTGAGAGCC ATCACCAGCGACTATG TCGTAGTGGGTAAAGC TGCACAGCTATCCATT | 1197 |

TABLE 46-continued

Gag-NCR and guide scaffold sequences-scaffold 174

| NCR protein | Architecture | Plasmid number | GAG-Protein Encoding Sequence SEQ ID NO | Hairpin encoding sequence | SEQ ID NO | Scaffold 174 + Hairpin Encoding Sequence | SEQ ID NO |
|---|---|---|---|---|---|---|---|
| | | | | | | GCACTCCGGATAGCTG TGCAGCATCAAAG | |
| QP | Gag-QP | pXDP373 | 1183 | ATGCATGTCTA AGACAGCAT | 1190 | ACTGGCGCTTTTATCT gATTACTTTGAGAGCC ATCACCAGCGACTATG TCGTAgTGGGTAAAGC tgcacATGCATGTCTA AGACAGCATgtgcAGC ATCAAAG | 1198 |
| GA | Gag-GA | pXDP362 | 1184 | AAAACATAAGG AAAACCTATGT T | 1191 | ACTGGCGCTTTTATCT GATTACTTTGAGAGCC ATCACCAGCGACTATG TCGTAGTGGGTAAAGC TGCACAAAACATAAGG AAAACCTATGTTGTGC AGCATCAAAG | 1199 |

Further experiments will be conducted using sgRNAs with two hairpins for binding by NCR proteins. Table 47, below, shows the sequences of the dual hairpin sgRNAs in scaffold 174 or scaffold 235

TABLE 47

Guide scaffold 174 and 235 sequences with dual hairpins

| Scaffold | Architecture | Sequence (5'-3') | SEQ ID NO |
|---|---|---|---|
| 362 | PP7 Dual HP-174 Scaffold based | ACTGGCGCTTTTATCTGATTACTTTGAGAGCCATCACCAGCGACTATGT CGTAGTGGGTAAAGCTGCACTATGGGCGCAGCAAGGAGTTTATATGGAA ACCCTTGCTGACGGTACAGGCCAAGGAGTTTATATGGAAACCCTTGGTA TAGTGCAGCATCAAAG | 35053 |
| 363 | AN Dual HP-174 Scaffold based | ACTGGCGCTTTTATCTGATTACTTTGAGAGCCATCACCAGCGACTATGT CGTAGTGGGTAAAGCTGCACTATGGGCGCAGCGCCCTGAAGAAGGGCGC TGACGGTACAGGCCGCCCTGAAGAAGGGCGGTATAGTGCAGCATCAAAG | 35054 |
| 364 | Tar Dual HP-174 Scaffold based | ACTGGCGCTTTTATCTGATTACTTTGAGAGCCATCACCAGCGACTATGT CGTAGTGGGTAAAGCTGCACTATGGGCGCAGCGGCTCGTGTAGCTCATT AGCTCCGAGCCGCTGACGGTACAGGCCGGCTCGTGTAGCTCATTAGCTC CGAGCCGGTATAGTGCAGCATCAAAG | 35055 |
| 365 | IRE Dual HP-174 Scaffold based | ACTGGCGCTTTTATCTGATTACTTTGAGAGCCATCACCAGCGACTATGT CGTAGTGGGTAAAGCTGCACTATGGGCGCAGCCCGTGTGCATCCGCAGT GTCGGATCCACGGGCTGACGGTACAGGCCCCGTGTGCATCCGCAGTGTC GGATCCACGGGGTATAGTGCAGCATCAAAG | 35056 |
| 366 | U1A Dual HP-174 Scaffold based | ACTGGCGCTTTTATCTGATTACTTTGAGAGCCATCACCAGCGACTATGT CGTAGTGGGTAAAGCTGCACTATGGGCGCAGCATCCATTGCACTCCGGA TAGCTGCTGACGGTACAGGCCATCCATTGCACTCCGGATAGCTGGTATA GTGCAGCATCAAAG | 35057 |
| 367 | QP Dual HP-174 Scaffold based | ACTGGCGCTTTTATCTGATTACTTTGAGAGCCATCACCAGCGACTATGT CGTAGTGGGTAAAGCTGCACTATGGGCGCAGCATGCATGTCTAAGACAG CATGCTGACGGTACAGGCCATGCATGTCTAAGACAGCATGGTATAGTGC AGCATCAAAG | 35058 |
| 368 | GA Dual HP-174 Scaffold based | ACTGGCGCTTTTATCTGATTACTTTGAGAGCCATCACCAGCGACTATGT CGTAGTGGGTAAAGCTGCACTATGGGCGCAGCAAAACATAAGGAAAACC TATGTTCTGACGGTACAGGCCAAAACATAAGGAAAACCTATGTTGGTAT AGTGCAGCATCAAAG | 35059 |
| 369 | PP7 Dual HP-235 Scaffold based | ACTGGCGCTTCTATCTGATTACTCTGAGCGCCATCACCAGCGACTATGT CGTAGTGGGTAAAGCCGCTTACGGACTATGGGCGCAGCAAGGAGTTTAT ATGGAAACCCTTGCTGACGGTACAGGCCAAGGAGTTTATATGGAAACCC TTGGTATAGTCCGTAAGAGGCATCAGAG | 35060 |

TABLE 47-continued

Guide scaffold 174 and 235 sequences with dual hairpins

| Scaffold | Architecture | Sequence (5'-3') | SEQ ID NO |
|---|---|---|---|
| 370 | AN Dual HP-235 Scaffold based | ACTGGCGCTTCTATCTGATTACTCTGAGCGCCATCACCAGCGACTATGT CGTAGTGGGTAAAGCCGCTTACGGACTATGGGCGCAGCGCCCTGAAGAA GGGCGCTGACGGTACAGGCCGCCCTGAAGAAGGGCGGTATAGTCCGTAA GAGGCATCAGAG | 35061 |
| 371 | Tar Dual HP-235 Scaffold based | ACTGGCGCTTCTATCTGATTACTCTGAGCGCCATCACCAGCGACTATGT CGTAGTGGGTAAAGCCGCTTACGGACTATGGGCGCAGCGGCTCGTGTAG CTCATTAGCTCCGAGCCGCTGACGGTACAGGCC GGCTCGTGTAGCTCATTAGCTCCGAGCC GGTATAGTCCGTAAGAGGCATCAGAG | 35062 |
| 372 | IRE Dual HP-235 Scaffold based | ACTGGCGCTTCTATCTGATTACTCTGAGCGCCATCACCAGCGACTATGT CGTAGTGGGTAAAGCCGCTTACGGACTATGGGCGCAGCCCGTGTGCATC CGCAGTGTCGGATCCACGGGCTGACGGTACAGGCCCCGTGTGCATCCGC AGTGTCGGATCCACGGGTATAGTCCGTAAGAGGCATCAGAG | 35063 |
| 373 | U1A Dual HP-235 Scaffold based | ACTGGCGCTTCTATCTGATTACTCTGAGCGCCATCACCAGCGACTATGT CGTAGTGGGTAAAGCCGCTTACGGACTATGGGCGCAGCATCCATTGCAC TCCGGATAGCTGCTGACGGTACAGGCCATCCATTGCACTCCGGATAGCT GGTATAGTCCGTAAGAGGCATCAGAG | 35064 |
| 374 | QP Dual HP-235 Scaffold based | ACTGGCGCTTCTATCTGATTACTCTGAGCGCCATCACCAGCGACTATGT CGTAGTGGGTAAAGCCGCTTACGGACTATGGGCGCAGCATGCATGTCTA AGACAGCATGCTGACGGTACAGGCCATGCATGTCTAAGACAGCATGGTA TAGTCCGTAAGAGGCATCAGAG | 35065 |
| 375 | GA Dual HP-235 Scaffold based | ACTGGCGCTTCTATCTGATTACTCTGAGCGCCATCACCAGCGACTATGT CGTAGTGGGTAAAGCCGCTTACGGACTATGGGCGCAGCAAAACATAAGG AAAACCTATGTTGCTGACGGTACAGGCCAAAACATAAGGAAAACCTATG TTGGTATAGTCCGTAAGAGGCATCAGAG | 35066 |

Example 17: Evaluation of Non-Covalent Recruitment (NCR) Systems with Dual MS2 Coat Protein for RNA Binding The purpose of these experiments was to evaluate whether inclusion of dual MS2 coat proteins (CP) linked to Gag and a single MS2 hairpin integrated into the guide RNA scaffold would enhance the potency of XDPs generated using this system, compared to constructs having a single copy of MS2 CP.

Methods:

All plasmids encoding CasX proteins had the CasX 491 variant protein.

Structural Plasmid Cloning

In order to generate the structural plasmids used to make the XDP, pXDP1 was digested using EcoRI to remove the Gag-pol sequence. Between one and three fragments containing CasX variant, HIV-1, or MS2 CP components were amplified and cloned as described in Example 7, above. The resultant plasmids were sequenced using Sanger sequencing to ensure correct assembly.

Guide Plasmid Cloning

The tdTomato targeting guide plasmid used in these experiments were pSG50 (scaffold 188; see FIG. 32) and pSG5 (scaffold 174), which were cloned from pSG33 and pSG3 respectively. The mammalian expression backbone contained a cPPT, ampicillin resistance, and a colEI replication site and was amplified using primers with appropriate overlaps to accept the U6 promoter and guide RNA scaffold cassette. The backbone was digested using NdeI and XbaI. Synthetic DNA fragments corresponding to guide scaffolds incorporating the MS2 hairpin were amplified and cloned as described in Example 7, above. The resultant plasmids, pSG3 and pSG33, were sequenced using Sanger sequencing to ensure correct assembly.

Cloning tdTomato Spacer 12.7 into pSG3 and pSG33

To clone the targeting pSG50 and pSG5 plasmids from the non-targeting pSG33 and pSG3 we cloned the spacer 12.7 using the following protocol. The targeting spacer sequence DNA for the tdTomato targeting spacer 12.7 was ordered as single-stranded DNA (ssDNA) oligos (Integrated DNA Technologies) consisting of the targeting sequence (CTG-CATTCTAGTTGTGGTTT, SEQ ID NO: 1018) and the reverse complement of this sequence. These two oligos were annealed together and cloned into a pSG plasmid with an alternate scaffold by Golden Gate assembly as described in Example 7, above. The resultant plasmids were sequenced using Sanger sequencing to ensure correct ligation (see Table 48).

TABLE 48

Encoded Guide and hairpin sequences

| Plasmid number | Scaffold | Spacer | Encoded Guide sequence | SEQ ID NO | Encoded Hairpin sequence | SEQ ID NO |
|---|---|---|---|---|---|---|
| pSG67 | 250 | NT | ACTGGCGCTTTTATCTGATTACTTT GAGAGCCATCACCAGCGACTATGTC GTAGTGGGTAAAGCTGCACTATGGG CGCAGCGTCAATGACGCTGACGGTA CAGGCCACATGAGGATCACCCATGT GGTATAGTGCAGCATCAAAGCGAGA CGTAATTACGTCTCG | 1200 | CAGCGTCAATGACGC TGACGGTACAGGCCA CATGAGGATCACCCA TGTGGTATAGTGC | 1204 |
| pSG68 | 251 | NT | ACTGGCGCTTTTATCTGATTACTTT GAGAGCCATCACCAGCGACTATGTC GTAGTGGGTAAAGCTGCACTATGGG CGCAGCTCATGAGGATCACCCATGA GCTGACGGTACAGGCCACATGAGGA TCACCCATGTGGTATAGTGCAGCAT CAAAGCGAGACGTAATTACGTCTCG | 1201 | CAGCTCATGAGGATC ACCCATGAGCTGACG GTACAGGCCACATGA GGATCACCCATGTGG TATAGTGC | 1205 |
| pSG72 | 250 | 12.7 | ACTGGCGCTTTTATCTGATTACTTT GAGAGCCATCACCAGCGACTATGTC GTAGTGGGTAAAGCTGCACTATGGG CGCAGCGTCAATGACGCTGACGGTA CAGGCCACATGAGGATCACCCATGT GGTATAGTGCAGCATCAAAGCTGCA TTCTAGTTGTGGTTT | 1202 | CAGCGTCAATGACGC TGACGGTACAGGCCA CATGAGGATCACCCA TGTGGTATAGTGC | 1204 |
| pSG73 | 251 | 12.7 | ACTGGCGCTTTTATCTGATTACTTT GAGAGCCATCACCAGCGACTATGTC GTAGTGGGTAAAGCTGCACTATGGG CGCAGCTCATGAGGATCACCCATGA GCTGACGGTACAGGCCACATGAGGA TCACCCATGTGGTATAGTGCAGCAT CAAAGCTGCATTCTAGTTGTGGTTT | 1203 | CAGCTCATGAGGATC ACCCATGAGCTGACG GTACAGGCCACATGA GGATCACCCATGTGG TATAGTGC | 1205 | pGP2 Glycoprotein Plasmid Cloning

Sequences encoding the VSV-G glycoprotein and the CMV promoter were amplified from pMD2.G (UC Berkeley) using Kapa HiFi DNA polymerase according to the manufacturer's protocols and primers appropriate for In-Fusion cloning. The backbone was taken from a kanamycin resistant plasmid and amplified and cloned using the same methods. These were purified by gel extraction from a 1% agarose gel using Zymoclean Gel DNA Recovery Kit according to the manufacturer's protocol. These fragments were cloned into plasmid backbones using In-Fusion® HD Cloning Kit from Takara according to manufacturer protocols. Assembled products were transformed into chemically-competent Turbo Competent E. coli bacterial cells, plated on LB-Agar plates containing kanamycin and incubated at 37° C. Individual colonies were picked and miniprepped using Qiagen spin Miniprep Kit following the manufacturer's protocol. The resultant plasmids were sequenced using Sanger sequencing to ensure correct assembly (see Table 51).

Cell Culture and Transfection

HEK293T Lenti-X cell culture was performed as described in Example 7, above. For transfection, the XDP structural plasmids (also encoding the CasX variants) of Table 51 were used in amounts ranging from 13 to 80.0 pg. Each transfection also received 13 µg of pSG50 or pSG5 and 0.25 µg of pGP2. The descriptions of the plasmids used to evaluate the NLS are listed in Table 50. Polyethylenimine (PEI Max from Polyplus) was then added as described in Example 7. Plasmid ratios in Table 49 were used in all version 206 XDPs used in this assay and are based on prior data from other XDP versions.

TABLE 49

Construct plasmids and ratios of plasmids used

| XDP version 206 plasmids | XDP version 309 plasmids | Structural plasmid ratios |
|---|---|---|
| Gag-(-1)-PR* pXDP161 | Gag-(-1)-PR* pXDP161 | 10% |
| Gag-MS2* pXDP164 | Gag-MS2-MS2* pXDP288 | 45% |
| CasX* pXDP166 | CasX* pXDP166 | 45% |

*transcript contains RRE and produces REV

TABLE 50

XDP plasmids for evaluation NLS effects

| XDP version | Architectures and glycoproteins | Plasmid numbers |
|---|---|---|
| V206 | Gag-(-1)-PR | pXDP161 |
|  | Gag-MS2 | pXDP164 |
|  | CasX | pXDP166 |
|  | VSV-G | pGP2 |
| V206 NLS 240 | Gag-(-1)-PR | pXDP161 |
|  | Gag-MS2 | pXDP164 |
|  | CasX w/NLS 240 | pXDP344 |
|  | VSV-G | pGP2 |
| V206NLS255 | Gag-(-1)-PR | pXDP161 |
|  | Gag-MS2 | pXDP164 |
|  | CasX w/NLS 255 | pXDP350 |
|  | VSV-G | pGP2 |

TABLE 51

Plasmid architecture and glycoprotein sequences

| Plasmid numbers | Architecture | SEQ ID NO of Encoding sequence |
|---|---|---|
| pGP2 | VSV-G | 1003 |
| pXDP161 | Gag-(-1)-PR | (see Table 35 for pXDP161 sequence) |
| pXDP164 | Gag-MS2 | (see Table 35 for pXDP164 sequence) |
| pXDP166 | SV40NLS-CasX491-SV40 NLS | (see Table 35 for pXDP166 sequence) |
| pXDP166 | SV40NLS-CasX491-SV40 NLS | (see Table 35 for pXDP166 sequence) |
| pXDP344 | AAV122_Cmyc_NLS-BPSV40_NLS_(GGGS)2_PG-CasX-SV40 | 1206 |
| pXDP350 | AAV119-CasX-AAV129 | 1207 |

Collection and Concentration

XDPs were collected and concentrated as described in Example 8, above.

Resuspension and Transduction tdTomato neural progenitor cells were resuspended and transduced as described in Example 7, above, and tdTomato fluorescence was measured using flow cytometry. tdTomato fluorescence was measured using flow cytometry. The assays were run 2-3 times for each sample, with similar results.

Figure 44:
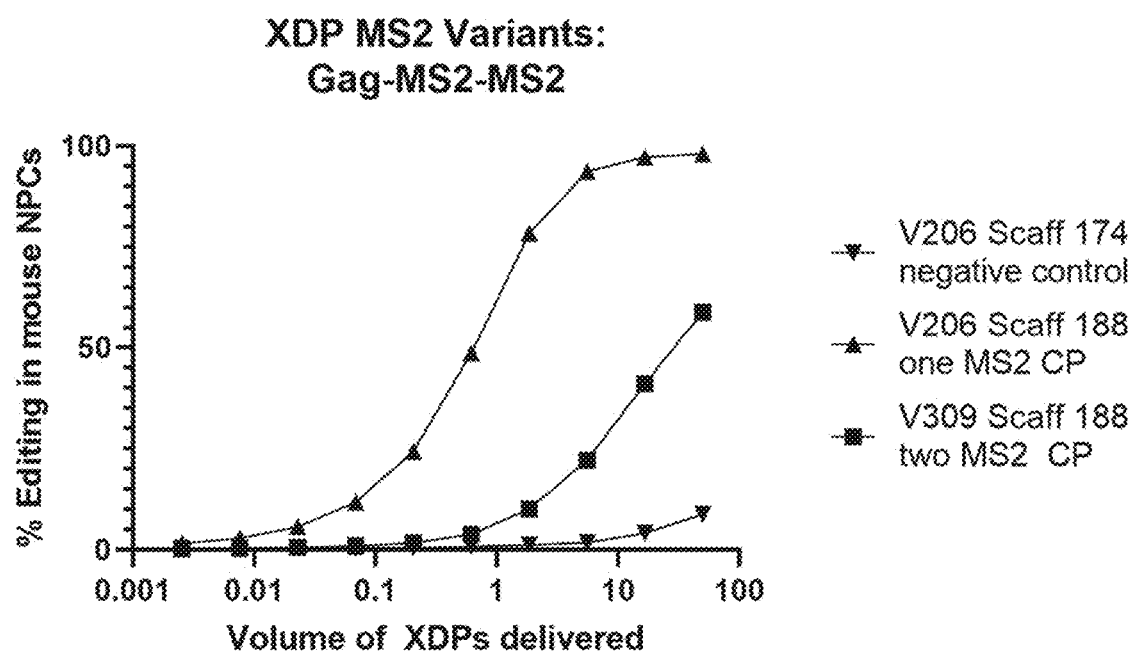
FIG. 44 is a graph of editing data for XDP with one or two MS2 coat proteins versus a control without MS2, as described in Example 17. The data are plotted as the percent edited cells versus the volume of XDPs delivered.
Figure 45:
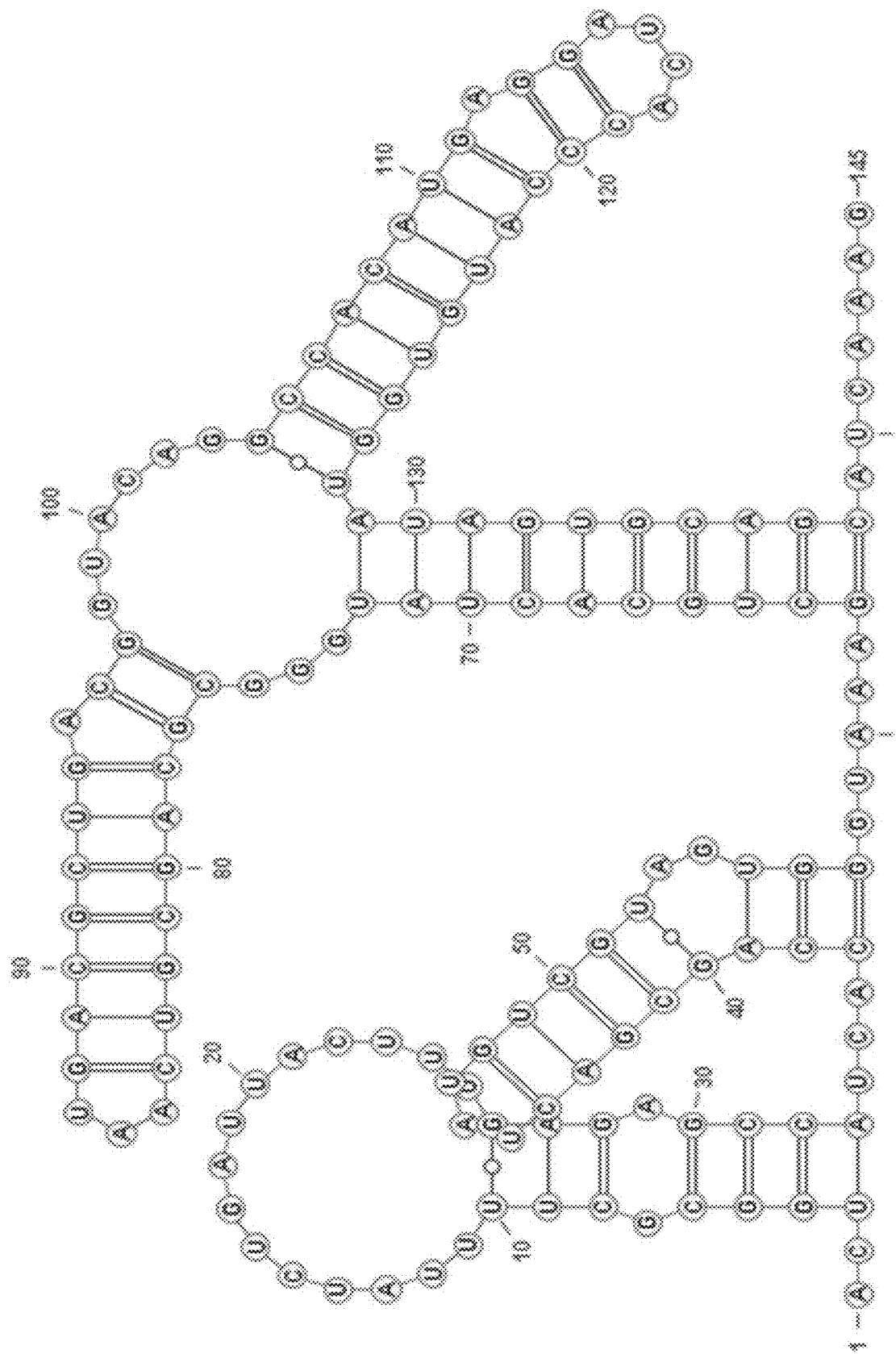
FIG. 45 is a schematic of the two-dimensional structure of guide scaffold 250, which has an MS2 hairpin on the right side and an RRE on the left side of the extended stem, as described in Example 18, Example 20, Example 25, and Example 27. The sequence in FIG. 45 is SEQ ID NO: 2307.
Figure 46:
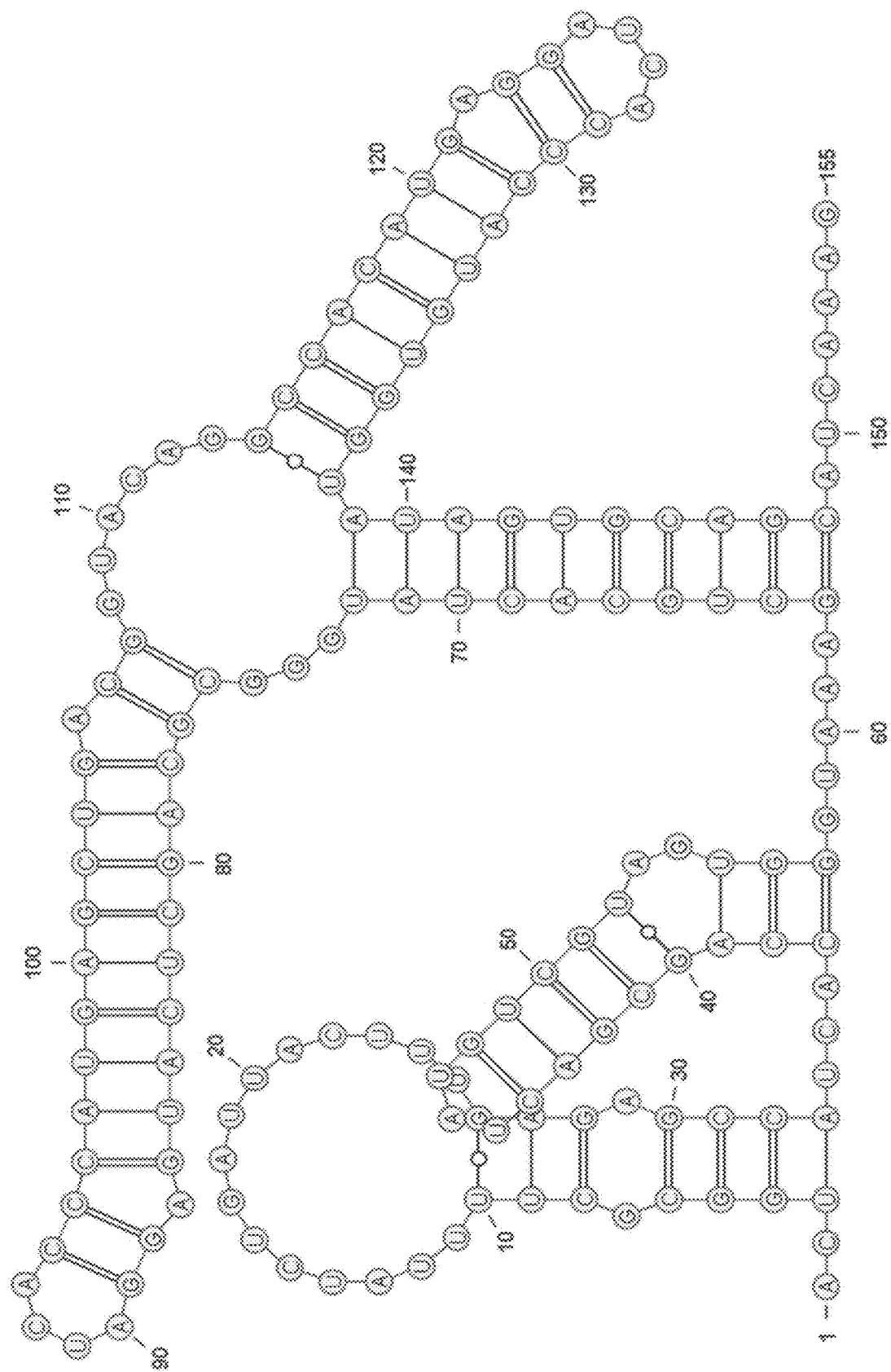
FIG. 46 is a schematic of the two-dimensional structure of guide scaffold 251, which has MS2 hairpins on the left and right sides and an RRE on the left side of the extended stem of the scaffold, as described in Example 18, Example 20, Example 25, Example 27, Example 33, and Example 34. The sequence in FIG. 46 is SEQ ID NO: 2308.
Figure 47:
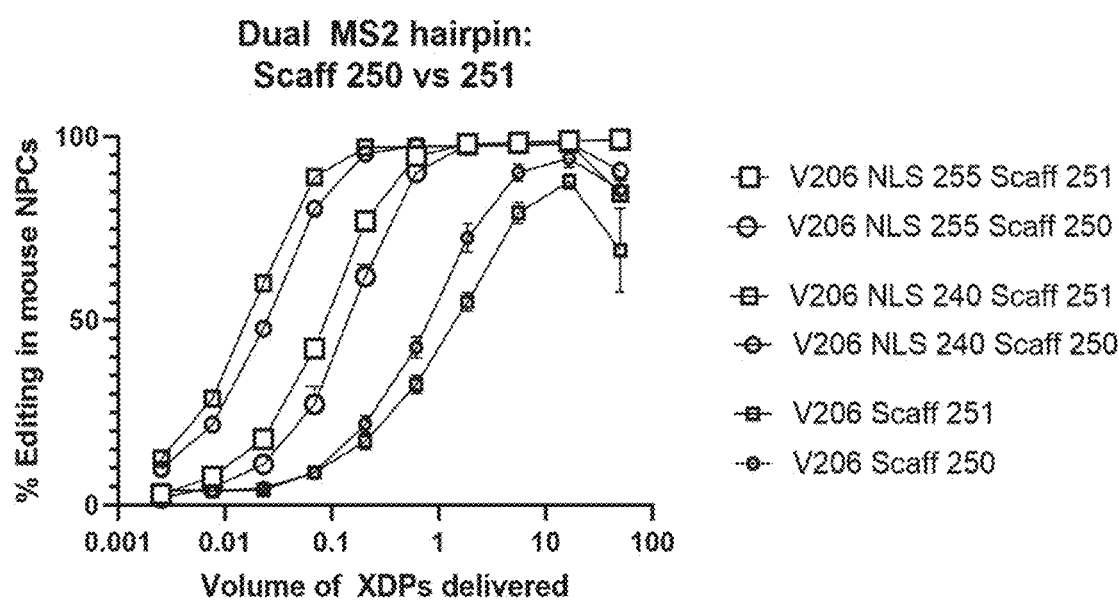
FIG. 47 is a graph of editing data from different XDPs based on Version 206 with guide scaffolds 250 (one MS2 hairpin) or 251 (dual MS2 hairpins) and CasX variants 240 or 255 (NLS variants), as described in Example 18.

Results:

XDP version 309 is identical to version 206 except there is an additional MS2 CP fused to the first MS2 in this system, so pXDP164 (which encodes Gag-MS2) is replaced with pXDP288, which encodes Gag-MS2-MS2. While the hypothesis was that inclusion of the additional MS2 would increase the avidity of the RNP with MS2 hairpin in the scaffolds for these coat proteins, thereby increasing the incorporation of RNP into the budding XDP, we observed that there was a significant decrease in editing with the constructs incorporating the second MS2 coat protein (see FIG. 44). The inverse of the EC50 by volume was 1.6 µL$^{-1}$ for V206 (single MS2) and 0.075 µL$^{-1}$ for V309 (double MS2). While V309 was still more potent than the negative control V206 without an MS2 hairpin containing scaffold (scaffold 174), which had an inverse EC50 of 0.012 µL$^{-1}$, the results nevertheless underscore the utility of incorporating the MS2 system in the XDP constructs. Reasons for the lower potency of the dual MS2 CP version over the single MS2 CP could be due to steric hindrance of particle formation caused by the second MS2, which possibly dimerizes with the first MS2, resulting in steric hindrance of the RNP and MS2 complex, or greater avidity of the complex causing inefficient release of the RNP in the target cell.

Example 18: Evaluation of Non-Covalent Recruitment (NCR) Systems with Dual MS2 Hairpins for MS2 Coat Protein Binding The purpose of these experiments was to determine if the incorporation of two MS2 hairpin RNA elements into the CasX sgRNA increased the potency of XDPs based on the MS2 coat protein hairpin recruitment system.

Methods:

All plasmids encoding CasX proteins utilized the CasX 491 variant protein.

Structural Plasmid Cloning

In order to generate the structural plasmids used to make the XDP, pXDP1 (obtained from UC Berkeley) was digested using EcoRI to remove the Gag-pol sequence. Between one and three fragments containing CasX variant, HIV-1, or MS2 CP components were amplified and cloned as described in Example 7, above. The resultant plasmids were sequenced using Sanger sequencing to ensure correct assembly.

Guide Plasmid Cloning

The tdTomato targeting guide plasmid used in these experiments were pSG72 (scaffold 250; see FIG. 45) and pSG68 (scaffold 251; see FIG. 46) which were cloned from pSG67 and pSG68 respectively. The mammalian expression backbone contained a cPPT, ampicillin resistance, and a colEI replication site and was amplified using primers with appropriate overlaps to accept the U6 promoter and guide RNA scaffold cassette. The backbone was digested using NdeI and XbaI. Synthetic DNA fragments corresponding to novel scaffolds were and cloned as described in Example 7, above. The resultant plasmids, pSG72 and pSG73, were sequenced using Sanger sequencing to ensure correct assembly (see Table 52).

TABLE 52 sgRNA encoding sequences

| Plasmid number | Scaffold | Spacer | Encoded Guide sequence | SEQ ID NO | Encoded Hairpin sequence | SEQ ID NO |
|---|---|---|---|---|---|---|
| pSG67 | 250 | NT | ACTGGCGCTTTTATCTGATTACTT TGAGAGCCATCACCAGCGACTATG TCGTAGTGGGTAAAGCTGCACTAT GGGCGCAGCGTCAATGACGCTGAC GGTACAGGCCACATGAGGATCACC CATGTGGTATAGTGCAGCATCAAA GCGAGACGTAATTACGTCTCG | 1200 | CAGCGTCAATGACG CTGACGGTACAGGC CACATGAGGATCAC CCATGTGGTATAGT GC | 1204 |
| pSG68 | 251 | NT | ACTGGCGCTTTTATCTGATTACTT TGAGAGCCATCACCAGCGACTATG TCGTAGTGGGTAAAGCTGCACTAT GGGCGCAGCTCATGAGGATCACCC ATGAGCTGACGGTACAGGCCACAT GAGGATCACCCATGTGGTATAGTG CAGCATCAAAGCGAGACGTAATTA CGTCTCG | 1201 | CAGCTCATGAGGAT CACCCATGAGCTGA CGGTACAGGCCACA TGAGGATCACCCAT GTGGTATAGTGC | 1205 |

TABLE 52-continued sgRNA encoding sequences

| Plasmid number | Scaffold | Spacer | Encoded Guide sequence | SEQ ID NO | Encoded Hairpin sequence | SEQ ID NO |
|---|---|---|---|---|---|---|
| pSG72 | 250 | 12.7 | ACTGGCGCTTTTATCTGATTACTT TGAGAGCCATCACCAGCGACTATG TCGTAGTGGGTAAAGCTGCACTAT GGGCGCAGCGTCAATGACGCTGAC GGTACAGGCCACATGAGGATCACC CATGTGGTATAGTGCAGCATCAAA GCTGCATTCTAGTTGTGGTTT | 1202 | CAGCGTCAATGACG CTGACGGTACAGGC CACATGAGGATCAC CCATGTGGTATAGT GC | 1204 |
| pSG73 | 251 | 12.7 | ACTGGCGCTTTTATCTGATTACTT TGAGAGCCATCACCAGCGACTATG TCGTAGTGGGTAAAGCTGCACTAT GGGCGCAGCTCATGAGGATCACCC ATGAGCTGACGGTACAGGCCACAT GAGGATCACCCATGTGGTATAGTG CAGCATCAAAGCTGCATTCTAGTT GTGGTTT | 1203 | CAGCTCATGAGGAT CACCCATGAGCTGA CGGTACAGGCCACA TGAGGATCACCCAT GTGGTATAGTGC | 1205 |

Cloning tdTomato Spacer 12.7 into pSG67 and pSG68

To clone the targeting pSG72 and 73 plasmids from the non-targeting pSG67 and pSG68, we cloned the spacer 12.7 using the following protocol. The targeting spacer sequence DNA for the tdTomato targeting spacer 12.7 was ordered as single-stranded DNA (ssDNA) oligos (Integrated DNA Technologies) consisting of the targeting sequence (CTG-CATTCTAGTTGTGGTTT, SEQ ID NO: 1018) and the reverse complement of this sequence. These two oligos were annealed together and cloned into a pSG plasmid with an alternate scaffold by Golden Gate assembly as described in Example 7, above. The resultant plasmids were sequenced using Sanger sequencing to ensure correct ligation.

pGP2 Glycoprotein Plasmid Cloning

Sequences encoding the VSV-G glycoprotein and the CMV promoter were amplified from pMD2.G (UC Berkeley) and cloned as described in Example 7, above. The backbone was taken from a kanamycin resistant plasmid and amplified and cloned using the same methods. Assembled products were transformed into chemically-competent Turbo Competent E. coli bacterial cells, plated on LB-Agar plates containing kanamycin and incubated at 37° C. The resultant plasmids were sequenced using Sanger sequencing to ensure correct assembly.

Cell Culture and Transfection

HEK293T Lenti-X cell culture was performed as described in Example 7, above. For transfection, the XDP structural plasmids (also encoding the CasX variants) of Table 54 were used in amounts ranging from 13 to 80.0 µg. Each transfection also received 13 µg of pSG50 or pSG5 and 0.25 µg of pGP2. Polyethylenimine (PEI Max from Polyplus) was then added as described in Example 7. Plasmid ratios in Table 53 were used in all version 206 XDPs used in this assay, based on prior data. Plasmid sequences are listed in Table 54. XDP version and components incorporated are listed in Table 55.

TABLE 53

Plasmids and ratios used

| XDP version 206 plasmids | Structural plasmid ratios |
|---|---|
| Gag-(-1)-PR | 10% |
| Gag-MS2 | 45% |
| CasX | 45% |

TABLE 54

Plasmid architecture and glycoprotein sequences

| Plasmid numbers | Architecture | SEQ ID NO of Encoding sequence |
|---|---|---|
| pGP2 | VSV-G | 1003 |
| pXDP161 | Gag-(-1)-PR | (see Table 35 for pXDP161 sequence) |
| pXDP164 | Gag-MS2 | (see Table 35 for pXDP164 sequence) |
| pXDP166 | SV40NLS-CasX491-SV40 NLS | (see Table 35 for pXDP166 sequence) |
| pXDP166 | SV40NLS-CasX491-SV40 NLS | (see Table 35 for pXDP166 sequence) |
| pXDP344 | AAV122_Cmyc_NLS-BPSV40_NLS_(GGGS)2_PG-CasX-SV40 | 1208 |
| pXDP350 | AAV119-CasX-AAV129 | 1209 |

TABLE 55

Version and pseudotyping descriptions

| XDP version | Architectures and glycoproteins | Plasmid numbers |
|---|---|---|
| 206 | Gag-(-1)-PR | pXDP161 |
|  | Gag-MS2 | pXDP164 |
|  | CasX | pXDP166 |
|  | VSV-G | pGP2 |
| 206 NLS 240 | Gag-(-1)-PR | pXDP161 |
|  | Gag-(-1)-PR | pXDP164 |
|  | CasX w/NLS 240 | pXDP344 |
|  | VSV-G | pGP2 |
| 206 NLS 255 | Gag-(-1)-PR | pXDP161 |
|  | Gag-MS2 | pXDP164 |

TABLE 55-continued

Version and pseudotyping descriptions

| XDP version | Architectures and glycoproteins | Plasmid numbers |
|---|---|---|
| | CasX w/NLS 255 VSV-G | pXDP350 pGP2 |

Collection and Concentration

XDPs were collected and concentrated as described in Example 7, above.

Resuspension and Transduction tdTomato neural progenitor cells were resuspended and transduced as described in Example 8, above, and tdTomato fluorescence was measured using flow cytometry. tdTomato fluorescence was measured using flow cytometry. The assays were run 2-3 times for each sample, with similar results.

Results:

We assayed two guide scaffolds, scaffold 250 (FIG. 45) and 251 (FIG. 46) in the version 206 system. Scaffold 250 has one MS2 hairpin and one RRE, and scaffold 251 has two MS2 hairpins and one RRE. We tested these versions in three different compositions. First was V206 with usual composition which contains SV40 NLSs on either side of the protein. Second, V206 with NLS 240, which is a stronger NLS than the SV40 in V206. Third, V206 with NLS 255 which has an NLS comparable to NLS 240. We found that with the NLS variants the dual MS2 scaffold 251 performed better than 250, and the opposite V206 with the normal SV40 NLS. However, as seen in Table 56 and FIG. 47, these scaffolds edited very similarly across all conditions. The potency was measured by inverse EC50, and with no NLS scaffold 250's inverse EC50 was 1.45 µL$^{-1}$ and 251's was 1.01 µL$^{-1}$. Versions with the NLS scaffold 251 were more potent than versions with the 250 scaffold. For version 206 NLS 240 scaffold 250, the inverse EC50 was 46.25 µL$^{-1}$ and for scaffold 251 was more than two-fold higher, at 98.33

The results support that guide scaffolds with two MS2 hairpins are capable of forming more potent XDP particles compared to a single MS2 hairpin. The results also show that in some cases, with CasX variants with alternate NLSs, the dual MS2 hairpin scaffolds can be beneficial to potency. Future experiments will evaluate whether greater than two MS2 hairpins further increase potency. This approach is applicable to not just MS2 hairpins but may apply to any RNA hairpin that can be used in CasX recruitment in XDPs such as Tar, Iron Responsive Element, U1A RNA, phage Qβ hairpin, phage GA hairpin, phage ΛN hairpin, Cys4 RNA stem loop, or other element with an RNA that binds protein in a sequence specific interaction with high affinity.

TABLE 56

Summary of scaffolds and results

| Scaffold | Variant | Left loop | right loop | Inverse EC50 by volume | Inverse EC50 by volume NLS 240 | Inverse EC50 by volume NLS 255 |
|---|---|---|---|---|---|---|
| 250 | 226 with one MS2 HP | normal | MS2 HP | 1.45 | 46.45 | 7.42 |
| 251 | 226 with dual MS2 HP | MS2 HP | MS2 HP | 1.10 | 98.33 | 12.69 |

Example 19: Modulating RNA Binding Partner—Psi-Based Recruitment

The purpose of this experiment was to demonstrate the utility of insertion of portions of the HIV-1 Psi packaging element into guide scaffolds as a mechanism for recruitment of CasX into XDPs during their formation by the affinity of the Psi element to the nucleocapsid component of Gag, thereby enhancing the potency of the XDPs.

Methods

All plasmids containing CasX proteins utilized the CasX491 protein. All XDPs were pseudotyped with 10% VSV-G (percentage of plasmid relative to the other plasmids utilized for the XDP construct). RNA fold structures were generated with RNAfold web server and Varna java-based software Structural Plasmid Cloning In order to generate the structural plasmids listed below, pXDP1 was digested using EcoRI to remove the Gag-pol sequence. Between one and three fragments encoding CasX or HIV-1 components were amplified using In Fusion primers with 15-20 base pair overlaps and Kapa HiFi DNA polymerase according to the manufacturer's protocols. The fragments were purified by gel extraction from a 1% agarose gel using Zymoclean Gel DNA Recovery Kit according to the manufacturer's protocol. These fragments were cloned into plasmid backbones using In-Fusion HD Cloning Kit from Takara according to the manufacturer's protocols. Assembled products were transformed into chemically-competent Turbo Competent *E. coli* bacterial cells, plated on LB-Agar plates containing ampicillin and incubated at 37° C. Individual colonies were picked and miniprepped using Qiagen spin Miniprep Kit following the manufacturer's protocol. The resultant plasmids were sequenced using Sanger sequencing to ensure correct assembly (see Table 57).

TABLE 57

Structural plasmid sequences

| Plasmid numbers | Architecture | SEQ ID NO of Encoding sequence |
|---|---|---|
| pXDP161 | Gag-(-1)-PR | (see Table 35 for pXDP161 sequence) |
| pXDP166 | SV40NLS-CasX491-SV40 NLS | (see Table 35 for pXDP166 sequence) |
| pXDP17 | Gag-CasX491-HAtag | 1210 |

Guide Plasmid Cloning

The guide plasmids used in these experiments are detailed Table 58, with the sequences inserted into the extended stem of the guide scaffold, as shown in FIGS. 50-53. The inserted sequences for pSG59-pSG64 were CTAGCGGAGGCTAG (SEQ ID NO: 1211), CTCGGCTTGCT-GAAGCGCGCACGGCAAGAGGCGAG (SEQ ID NO: 1212), CTCTCTCGACGCAGGACTCGGCTTGCT-GAAGCGCGCACGGCAAGAGGCGAGGGGCGGC GACTGGTGAGTACGCCAAAAATTTTGACTAGCG-GAGGCTAGAAGGAGAGAG (SEQ ID NO: 1213), GGTGCCCGTCTGTTGTGTCGAGAGACGC-CAAAAATTTTGACTAGCGGAGGCTAGAAGG AGAGAGATGGGTGCC (SEQ ID NO: 1214), ATG-GAGAGGAGAT (SEQ ID NO: 2379), and ATGGAGAT, respectively. The mammalian expression backbone contained a cPPT, ampicillin resistance, and a colEI replication site and was amplified using primers with appropriate overlaps to accept the U6 promoter and guide RNA scaffold cassette. These fragments were amplified and cloned as described in Example 7, above. The resultant plasmids were sequenced using Sanger sequencing to ensure correct assembly.

Cloning tdTomato Spacer 12.7 into pSG3 and pSG14

The targeting spacer sequence DNA for the tdTomato targeting spacer 12.7 was cloned as described in Example 12, above. The resultant plasmids were sequenced using Sanger sequencing to ensure correct ligation (see Table 58).

(see Table 59 for ratios used). Each transfection also received 13 µg of a pSG plasmid and 0.25 µg of pGP2. Polyethylenimine (PEI Max from Polyplus) was then added as described in Example 7.

TABLE 59

Construct plasmids and ratios of plasmids used

| Plasmid numbers | Architecture | XDP version 168 | XDP version 207 |
|---|---|---|---|
| pXDP161 | Gag-(-1)-PR* | 10% | 10% |
| pXDP17 | Gag-CasX | 90% | 0% |
| pXDP166 | CasX* | 0% | 90% |

*Transcript contains RRE

TABLE 58

Guide scaffold sequences

| Name | Plasmid numbers | Scaffold | Scaffold sequence SEQ ID NO | Encoding Hairpin sequence | Hairpin SEQ ID NO | EC50 by volume | Size |
|---|---|---|---|---|---|---|---|
| Psi SL3 | pSG0059 | 243 | 1215 | CTAGCGGAGGCTAG | 1221 | 0.9775 | 14 |
| Full length SL1 | pSG0060 | 244 | 1216 | CTCGGCTTGCTGAAGCGCGCACGGCAAGAGGCGAG | 1222 | 4.264 | 35 |
| Full Psi without SL4 | pSG0061 | 245 | 1217 | CTCTCTCGACGCAGGACTCGGCTTGCTGAAGCGCGCACGGCAAGAGGCGAGGGCGGCGACTGGTGAGTACGCCAAAAATTTTGACTAGCGGAGGCTAGAAGGAGAGAG | 1223 | 5.559 | 109 |
| Ψ3WJ-1 | pSG0062 | 246 | 1218 | GGTGCCCGTCTGTTGTGTCGAGAGACGCCAAAAATTTTGACTAGCGGAGGCTAGAAGGAGAGAGATGGGTGCC | 1224 | 4.184 | 73 |
| Two GGAG elements | pSG63 | 247 | 1219 | ATGGAGAGGAGAT | 1225 | 2.497 | 13 |
| One GGAG element | pSG64 | 248 | 1220 | ATGGAGAT | NA | 1.786 | 8 | pGP2 Glycoprotein Plasmid Cloning

Sequences encoding the VSV-G glycoprotein and the CMV promoter were amplified from pMD2.G (UC Berkeley) and cloned as described in Example 7, above. The backbone was taken from a kanamycin resistant plasmid and amplified and cloned using the same methods. Assembled products were transformed into chemically-competent Turbo Competent *E. coli* bacterial cells, plated on LB-Agar plates containing kanamycin and incubated at 37° C. The resultant plasmids were sequenced using Sanger sequencing to ensure correct assembly.

Cell Culture and Transfection

HEK293T Lenti-X cell culture was performed as described in Example 7, above. For transfection, the XDP structural plasmids (also encoding the CasX variants) of Table 59 were used in amounts ranging from 13 to 80.0 µg Collection and Concentration XDPs were collected and concentrated as described in Example 8, above.

Resuspension and Transduction tdTomato neural progenitor cells were resuspended and transduced as described in Example 7, above, and tdTomato fluorescence was measured using flow cytometry. The assays were run 2-3 times for each sample with similar results.

Results:

Six different structural motifs elements were chosen from the HIV-1 Psi element, an RNA sequence from the HIV-1 genome that has a high affinity for the nucleocapsid. Results indicate that XDP constructs made with guide scaffolds 243, 247, and 248 resulted in the highest levels of editing in this assay (see Table 58 and FIG. 54). As these elements were some of the smallest insertions and (contained, respectively, stem loop 3, two GGAG element, and one GGAG element), and Stem loop 3 and GGAG have a documented high affinity for NC, it is likely the size of the insertion is an important factor for the increased potency seen.

These data demonstrate that enhancements in editing with XDPs can be generated through incorporation of recruiting RNA elements into the extended stem of the guide scaffold. It is noteworthy that these XDP particles were able to achieve enhancements in editing in mouse neural progenitor cells through no other mechanism of RNA recruitment other than the Psi-NC interaction.

Example 20: Evaluation of RNA Binding Partners RRE and MS2

The purpose of the experiments was to evaluate the utility of the MS2 and RRE systems into constructs to assess their ability to enhance the creation and potency of XDP. Here we describe the generation of XDPs where the CasX is recruited into the XDPs by fusing MS2 coat to different proteins within the HIV Gag polyprotein and the guide scaffold has one or two MS2 hairpins and portions of the HIV-1 Rev Response Element (RBE).

Methods:

All plasmids containing CasX proteins had the CasX 491 variant protein. All XDPs were pseudotyped with 10% VSV-G. RNA fold structures were generated with RNAfold web server and Varna java-based software.

Structural Plasmid Cloning

In order to generate the structural plasmids used to make the XDP, pXDP1 was digested using EcoRI to remove the Gag-pol sequence. Between one and three fragments containing CasX, HIV-1, or MS2 CP components were amplified using In Fusion primers with 15-20 base pair overlaps and Kapa HiFi DNA polymerase according to the manufacturer's protocols. The fragments were purified by gel extraction from a 1% agarose gel using Zymoclean Gel DNA Recovery Kit according to the manufacturer's protocol. These fragments were cloned into plasmid backbones using In-Fusion HD Cloning Kit from Takara according to the manufacturer's protocols. Assembled products were transformed into chemically-competent Turbo Competent E. coli bacterial cells, plated on LB-Agar plates containing ampicillin and incubated at 37° C. Individual colonies were picked and miniprepped using Qiagen spin Miniprep Kit following the manufacturer's protocol. The resultant plasmids were sequenced using Sanger sequencing to ensure correct assembly (see Table 60).

TABLE 60

Structural sequences

| Plasmid numbers | Architecture | SEQ ID NO of Encoding Sequence |
|---|---|---|
| pGP2 | VSV-G | 1003 |
| pXDP161* | Gag-(-1)-PR | (see Table 35 for pXDP161 sequence) |
| pXDP164* | Gag-(-1)-MS2 CP | 1226 |
| pXDP166* | SV40NLS-CasX491-SV40 NLS | (see Table 35 for pXDP166 sequence) |

*Backbone of plasmid expresses Rev

Guide Plasmid Cloning

The tdTomato targeting guide plasmids used in these experiments were pSG 17, pSG pSG72 to pSG76 cloned from non-targeting plasmids pSG14 and pSG67 to pSG71, respectively. The configurations and the sequences of these plasmids and the inserted elements are provided in Tables 61 and 62, respectively. The mammalian expression backbone contained a cPPT, ampicillin resistance, and a colEI replication site and was amplified using primers with appropriate overlaps to accept the U6 promoter and guide RNA scaffold cassette. The backbone was digested using NdeI and XbaI. Synthetic DNA fragments corresponding to novel scaffolds were amplified and cloned as described in Example 7, above. The resultant plasmids, pSG3 and pSG5, were sequenced using Sanger sequencing to ensure correct assembly (see Table 62).

TABLE 61

Guide scaffold design

| Scaffold | Variant | Left loop | Right loop | FIG. |
|---|---|---|---|---|
| 250 | RBE with one MS2 HP | — | MS2 HP | 45 |
| 251 | RBE with dual MS2 HP | MS2 HP | MS2 HP | 46 |
| 252 | Dual RBE | — | RBE | — |
| 254 | Dual RBE + one MS2 | RBE | MS2 | 55 |

TABLE 62

Scaffold sequences

| Plasmid numbers | Scaffold number | Target | Encoding Guide Sequence | SEQ ID NO |
|---|---|---|---|---|
| pSG0033 | 188 | NT | ACTGGCGCTTTTATCTGATTACTTTGAGAGCCATCACCA GCGACTATGTCGTAGTGGGTAAAGCTCACATGAGGATCA CCCATGTGAGCATCAAAGCGAGACGTAATTACGTCTCG | 1135 |
| pSG50 | 188 | 12.7 | ACTGGCGCTTTTATCTGATTACTTTGAGAGCCATCACCA GCGACTATGTCGTAGTGGGTAAAGCTCACATGAGGATCA CCCATGTGAGCATCAAAGCGAGACGTAATTACGTCTCG | 1135 |
| pSG67 | 250 | NT | ACTGGCGCTTTTATCTGATTACTTTGAGAGCCATCACCA GCGACTATGTCGTAGTGGGTAAAGCTCACTATGGGCGC AGCGTCAATGACGCTGACGGTACAGGCCACATGAGGATC ACCCATGTGGTATAGTGCAGCATCAAAGCGAGACGTAAT TACGTCTCG | 1200 |
| pSG68 | 251 | NT | ACTGGCGCTTTTATCTGATTACTTTGAGAGCCATCACCA GCGACTATGTCGTAGTGGGTAAAGCTCACTATGGGCGC AGCTCATGAGGATCACCCATGAGCTGACGGTACAGGCCA | 1201 |

TABLE 62-continued

Scaffold sequences

| Plasmid numbers | Scaffold number | Target | Encoding Guide Sequence | SEQ ID NO |
|---|---|---|---|---|
| | | | CATGAGGATCACCCATGTGGTATAGTGCAGCATCAAAGC GAGACGTAATTACGTCTCG | |
| pSG69 | 252 | NT | ACTGGCGCTTTTATCTGATTACTTTGAGAGCCATCACCA GCGACTATGTCGTAGTGGGTAAAGCTGCACTATGGGCGC AGCGTCAATGACGCTGACGGTACAGGCCACATGGCAGTC GTAACGACGCGGGTGGTATAGTGCAGCATCAAAGCGAGA CGTAATTACGTCTCG | 1227 |
| pSG71 | 254 | NT | ACTGGCGCTTTTATCTGATTACTTTGAGAGCCATCACCA GCGACTATGTCGTAGTGGGTAAAGCTGCACTATGGGCGC AGACATGGCAGTCGTAACGACGCGGGTCTGACGGTACAG GCCACATGAGGATCACCCATGTGGTATAGTGCAGCATCA AAGCGAGACGTAATTACGTCTCG | 1228 |
| pSG72 | 250 | 12.7 | ACTGGCGCTTTTATCTGATTACTTTGAGAGCCATCACCA GCGACTATGTCGTAGTGGGTAAAGCTGCACTATGGGCGC AGCGTCAATGACGCTGACGGTACAGGCCACATGAGGATC ACCCATGTGGTATAGTGCAGCATCAAAGCTGCATTCTAG TTGTGGTTT | 1202 |
| pSG73 | 251 | 12.7 | ACTGGCGCTTTTATCTGATTACTTTGAGAGCCATCACCA GCGACTATGTCGTAGTGGGTAAAGCTGCACTATGGGCGC AGCTCATGAGGATCACCCATGAGCTGACGGTACAGGCCA CATGAGGATCACCCATGTGGTATAGTGCAGCATCAAAGC TGCATTCTAGTTGTGGTTT | 1203 |
| pSG74 | 252 | 12.7 | ACTGGCGCTTTTATCTGATTACTTTGAGAGCCATCACCA GCGACTATGTCGTAGTGGGTAAAGCTGCACTATGGGCGC AGCGTCAATGACGCTGACGGTACAGGCCACATGGCAGTC GTAACGACGCGGGTGGTATAGTGCAGCATCAAAGCTGCA TTCTAGTTGTGGTTT | 1229 |
| pSG76 | 254 | 12.7 | ACTGGCGCTTTTATCTGATTACTTTGAGAGCCATCACCA GCGACTATGTCGTAGTGGGTAAAGCTGCACTATGGGCGC AGACATGGCAGTCGTAACGACGCGGGTCTGACGGTACAG GCCACATGAGGATCACCCATGTGGTATAGTGCAGCATCA AAGCTGCATTCTAGTTGTGGTTT | 1230 |

Cloning tdTomato Spacer 12.7 into pSG3, pSG14, pSG13, and pSG67 to pSG71

The targeting spacer sequence DNA for the tdTomato targeting spacer 12.7 was ordered as single-stranded DNA (ssDNA) oligos (Integrated DNA Technologies) consisting of the targeting sequence (CTGCATTCTAGTTGTGGTTT, SEQ ID NO: 1018) and the reverse complement of this sequence. These two oligos were annealed together and cloned into the non-targeting (CGAGACGTAAT-TACGTCTCG, SEQ ID NO: 1019) plasmids with an alternate scaffold by Golden Gate assembly, as described in Example 7, above. The resultant plasmids were sequenced using Sanger sequencing to ensure correct ligation (see Table 62).

pGP2 Glycoprotein Plasmid Cloning

Sequences encoding the VSV-G glycoprotein and the CMV promoter were amplified and cloned as described in Example 7, above. The backbone was taken from a kanamycin resistant plasmid and amplified and cloned using the same methods. Assembled products were transformed into chemically-competent Turbo Competent *E. coli* bacterial cells, plated on LB-Agar plates (LB: Teknova Cat #L9315, Agar: Quartzy Cat #214510) containing kanamycin and incubated at 37° C. The resultant plasmids were sequenced using Sanger sequencing to ensure correct assembly.

Cell Culture and Transfection

HEK293T Lenti-X cell culture was performed as described in Example 7, above. For transfection, the XDP structural plasmids (also encoding the CasX variants) of Table 63 were used in amounts ranging from 13 to 80.0 pg. Each transfection also received 13 μg of a pSG plasmid and 0.25 μg of pGP2. Polyethylenimine (PEI Max from Polyplus) was then added as described in Example 7.

TABLE 63

XDP plasmids

| XDP version | Architectures | Plasmid numbers | Rev expression |
|---|---|---|---|
| 206 | Gag-(−1)-PR Gag-MS2 CasX VSV-G | pXDP161 pXDP164 pXDP166 pGP2 | Yes |

Collection and Concentration

XDPs were collected and concentrated as described in Example 8, above.

Resuspension and Transduction tdTomato neural progenitor cells were resuspended and transduced as described in Example 7, above, and tdTomato fluorescence was measured using flow cytometry. The assays were run 2-3 times for each sample with similar results (see Table 64).

Results:

The results in FIG. 56, FIG. 57, and Table 64 demonstrate that the inclusion of RBEs (scaffolds 250, 251, and 254)

does not significantly decrease the potency of V206 XDPs, so long as the guide scaffold also contains at least one MS2 hairpin. Scaffolds 250 and 254 had EC50s within 2-fold of scaffold 188 (MS2 hairpin only). The results presented in FIG. 57 demonstrate that guide scaffold 251, which has two MS2 hairpins, is only slightly less potent than guide scaffold 188, which could be due to the second MS2 hairpin in this scaffold.

TABLE 64

EC50 results of XDP configured with MS2 and RBE

| Scaffold | # RBE | # MS2 HP | EC50 |
|---|---|---|---|
| 188 | 0 | 1 | 9.66E+06 |
| 250 | 1 | 1 | 1.68E+07 |
| 252 | 2 | 0 | 7.46E+08 |
| 254 | 2 | 1 | 1.90E+07 |

Example 21: Enhancing Tropism and Editing Potency with Vesiculovirus Glycoprotein Variants The purpose of these experiments was to evaluate the ability of diverse glycoprotein variants to enhance tropism for target cells and improve overall editing of the XDP constructs bearing the glycoprotein variants compared to a standard control VSV-G glycoprotein.

Editing efficiency and specificity can be altered and enhanced with the method of CasX delivery that is employed. Vesicular stomatitis virus envelope glycoprotein (VSV-G) have been widely used to pseudotype viral vectors. However, VSV-G has been shown to be susceptible to human complement inactivation. Experiments were conducted to demonstrate that XDPs (V168 with scaffold 226 targeting TdTomato) can be effectively pseudotyped with envelope glycoproteins derived from other species within the Vesiculovirus genus to produce potent particles that can successfully edit target cells. This would offer several advantages: 1) some of these variant glycoproteins maybe relatively resistant to complement inactivation with human serum; 2) some of these variant glycoproteins may exhibit enhanced tropism; and 3) having XDPs pseudotyped with different glycoproteins that are distinct from each other may enable repeated dosing of the therapeutic modality (with different glycoproteins) to circumvent the humoral immune response that could be induced to the previous glycoprotein.

Methods:

The XDP version 168 configuration was used, with guide scaffold 226 targeting TdTomato. All plasmids containing CasX proteins encoded the CasX 491 protein. The guide RNA spacer used in all of these experiments is 12.7 targeting the tdTomato locus that is incorporated in scaffold 226 encoded in pSG17. RNA fold structures were generated with RNAfold web server and Varna java-based software.

Structural Plasmid Cloning

In order to generate the structural plasmids used to make the XDP, configured as V168, pXDP1 was digested using EcoRI to remove the Gag-pol sequence. Between one and three fragments containing CasX and HIV-1 components were amplified and cloned as described in Example 7, above. The resultant plasmids were sequenced using Sanger sequencing to ensure correct assembly. The structural plasmids and their sequences are listed in Table 65.

TABLE 65

Plasmid sequences for structural plasmids and glycoproteins

| XDP version number/ Source viral species | Plasmid number | SEQ ID NO |
|---|---|---|
| | pXDP161 | (see Table 35 for pXDP161 sequence) |
| | pXDP17 | 1231 |
| | pSG17 | 1232 |
| | pGP2 | 1003 |
| VSAV | pGP92 | 1233 |
| ABVV | pGP99 | 1234 |
| CARV | pGP98 | 1235 |
| CHPV | pGP97 | 1236 |
| COCV | pGP100 | 1237 |
| VSIV | pGP91 | 1238 |
| ISFV | pGP90 | 1239 |
| JURV | pGP87 | 1240 |
| MSPV | pGP89 | 1241 |
| MARV | pGP88 | 1242 |
| MORV | pGP101 | 1243 |
| VSNJV | pGP84 | 1244 |
| PERV | pGP85 | 1245 |
| PIRYV | pGP94 | 1246 |
| RADV | pGP96 | 1247 |
| YBV | pGP86 | 1248 |
| VSV CEN AM-94GUB | pGP93 | 1249 |
| VSV South America 85CLB | pGP95 | 1250 |

Guide Plasmid Cloning

The guide plasmid used in these experiments was pSG17, which encodes the spacer 12.7 targeting tdTomato incorporated into the guide scaffold 226 that also has the RRE/RBE element described in previous examples. To clone the targeting pSG17, we cloned the spacer 12.7 using the following protocol. The targeting spacer sequence DNA for the tdTomato targeting spacer 12.7 was ordered as single-stranded DNA (ssDNA) oligos (Integrated DNA Technologies) consisting of the targeting sequence (CTGCATTCTAGTTGTGGTTT, SEQ ID NO: 1018) and the reverse complement of this sequence. These two oligos were annealed together and cloned into a pSG plasmid with an alternate scaffold by Golden Gate assembly, as described in Example 12, above. The resultant plasmids were sequenced using Sanger sequencing to ensure correct ligation.

pGP Glycoprotein Plasmid Cloning

Encoding sequences for glycoproteins from different species within the Vesiculovirus genus were derived and are provided in Table 65. The designed constructs were synthesized as transgenes and purchased pre-cloned into pTWIST expression plasmids from Twist Biosciences. The resultant plasmids were sequenced using Sanger sequencing to ensure correct assembly.

pGP2 (which serves as the control GP) plasmid cloning was done by amplifying the sequences encoding the VSV-G glycoprotein and the CMV promoter from pMD2.G (UC Berkeley). The backbone was taken from a kanamycin resistant plasmid and amplified and cloned using the same methods. Amplification and cloning were performed as described in Example 7, above. Assembled products were transformed into chemically-competent Turbo Competent E. coli bacterial cells, plated on LB-Agar plates containing kanamycin and incubated at 37° C. The resultant plasmids were sequenced using Sanger sequencing to ensure correct assembly.

Cell Culture and Transfection

HEK293T Lenti-X cell culture was performed as described in Example 7, above. For transfection, the XDP structural plasmids (sequences listed in Table 65) were used in amounts ranging from 13 to 80.0 pg. Each transfection also received 13 μg of p42.174.12.7 and 2.5 μg of pGP2. Polyethylenimine (PEI Max from Polyplus) was then added as described in Example 7.

Collection and Concentration

XDPs were collected and concentrated as described in Example 8, above. Resuspension and transduction tdTomato neural progenitor cells were resuspended and transduced as described in Example 7, above, and tdTomato fluorescence was measured using flow cytometry. The assays were run 2-3 times for each sample, with similar results.

Results:

Percent editing of the dtTomato target sequence in tdT NPCs are shown for all the constructs in FIG. 59 in terms of number of particles used to treat the cells and, in FIG. 60 in terms of the volume of XDPs used to treat the cells. This is broken up further with the percent editing in tdT NPCs elicited when 0.2 μl and 0.06 μl of the concentrated XDP prep were used to treat NPCs, as shown in FIG. 61. The EC50 values for the different constructs were calculated and plotted as shown in FIG. 62 and fold-improvements in EC50 over the base control GP (pGP2) are shown in FIG. 64. The data demonstrate that incorporation of 8 different GPs (pGP101, pGP100, 99, 98, 95, 93, 91 and 88) resulted in between a 2 to 7-fold improvement over the base control GP (pGP2). FIG. 63 shows that the XDPs pseudotyped with different glycoproteins produce to comparable levels with equivalent titers relative to the control construct. These results show that XDPs can be effectively pseudotyped with envelope glycoproteins derived from other species within the Vesiculovirus genus to produce potent particles that can successfully edit the target cell (tdT NPCs). In particular, several glycoproteins, including pGP101, pGP100, 99, 98, 95, 93, 91 and 88, showed promise for enhanced tropism and editing by the resulting XDP.

Given that XDPs based on an HIV architecture have been successfully pseudotyped with these variant glycoproteins, it will be possible to use these glycoproteins to pseudotype other versions of XDPs derived from any architectural variants based on components from Alpharetroviral, Betaretroviral, Gammaretroviral, Deltaretroviral, Epsilonretroviral, Lentiviral and Spumaretroviral origin.

Example 22: Enhancing Tropism and Editing Potency with Glycoprotein Variants for XDP Based on Lentiviral and Alpharetrovirus Constructs The purpose of these experiments was to evaluate the ability of diverse glycoprotein variants to enhance tropism for target cells and improve overall editing of XDP based on lentiviral and Alpharetroviral constructs bearing the glycoprotein variants.

Editing efficiency and specificity can be altered and enhanced with the method of CasX delivery that is employed. Vesicular stomatitis virus envelope glycoprotein (VS V-G) has been widely used to pseudotyped viral vectors. However, VSV-G has been shown to be susceptible to human complement inactivation. Experiments were conducted to demonstrate that XDPs derived from lentiviral based HIV (V168 with scaffold 226 targeting TdTomato) as well as other retroviruses such as ALV (V44 and V102 with scaffold 174 targeting TdTomato) can be effectively pseudotyped with envelope glycoproteins derived from other viral families including but not limited to Togaviridae, Paramyxoviridae, Rhabdoviridae, Orthomyxoviridae, Retroviridae and Flaviviridae to produce potent particles that can successfully edit target cells.

Methods:

All plasmids containing CasX proteins encoded the CasX 491 variant protein. RNA fold structures were generated with RNAfold web server and Varna java-based software.

Structural Plasmid Cloning

In order to generate the structural plasmids used to make the XDP, pXDP1 (obtained from UC Berkeley) was digested using EcoRI to remove the Gag-pol sequence. Between one and three fragments containing CasX ALV and HIV-1 components were amplified and cloned as described in Example 7, above. The resultant plasmids were sequenced using Sanger sequencing to ensure correct assembly. Plasmids and their sequences are listed in Table 66.

TABLE 66

Plasmid sequences for structural plasmids and glycoproteins

| XDP version number/ Viral source | Plasmid number | SEQ ID NO |
|---|---|---|
| 168 | pXDP161 | (see Table 35 for pXDP161 sequence) |
| 168 | pXDP17 | 1251 |
|  | pSG17 | 1252 |
|  | pSG005 | 1253 |
| 44 | pXDP40 | 1254 |
| 102 | pXDP145 | 1255 |
|  | pGP2 | 1003 |
| H5N1 | pGP80 | 1256 |
| H7N9 | pGP81 | 1257 |
| Eastern equine encephalitis virus (EEEV) | pGP65 | 1258 |
| Venezuelan equine encephalitis viruses (VEEV) | pGP66 | 1259 |
| Western equine encephalitis virus (WEEV) | pGP67 | 1260 |
| Semliki Forest virus | pGP68 | 1261 |
| Sindbis virus | pGP69 | 1262 |
| Chikungunya virus (CHIKV) | pGP70 | 1263 |
| Bornavirus BoDV-1 | pGP58 | 1264 |
| Tick-borne encephalitis virus (TBEV) | pGP71 | 1265 |
| Rabies virus (strain Nishigahara RCEH) (RABV) | pGP29.3 | 1266 |
| Rabies virus (strain India) (RABV) | pGP29.4 | 1267 |
| Rabies virus (strain CVS-11) (RABV) | pGP29.5 | 1268 |
| Rabies virus (strain ERA) (RABV) | pGP29.6 | 1269 |
| Rabies virus (strain SAD B19) (RABV) | pGP29.7 | 1270 |
| Rabies virus (strain Vnukovo-32) (RABV) | pGP29.8 | 1271 |
| Rabies virus (strain Pasteur vaccins/PV) (RABV) | pGP29.9 | 1272 |
| Rabies virus (strain PM1503/AVO1) (RABV) | pGP29.1 | 1273 |
| Rabies virus (strain China/DRV) (RABV) | pGP29.11 | 1274 |
| Rabies virus (strain China/MRV) (RABV) | pGP29.12 | 1275 |
| Rabies virus (isolate Human/Algeria/1991) (RABV) | pGP29.13 | 1276 |
| Rabies virus (strain HEP-Flury) (RABV) | pGP29.14 | 1277 |
| Rabies virus (strain silver-haired bat-associated) (RABV) (SHBRV) | pGP29.15 | 1278 |
| Codon optimized rabies virus | pGP29.2 | 1279 |
| Rabies Virus | pGP29 | 1280 |
| Mokola Virus | pGP30 | 1281 |
| Measles Virus | pGP32.1 | 1282 |
| Measles Virus | pGP32.2 | 1283 |
| Mouse mammary tumor virus | pGP6 | 1284 |
| Human T-lymphotropic virus 1 | pGP7 | 1285 |
| RD114 Endogenous Feline Retrovirus | pGP8 | 1286 |
| Gibbon ape leukemia virus | pGP9 | 1287 |
| Moloney Murine leukemia virus | pGP10 | 1288 |
| Baboon Endogenous Virus | pGP11 | 1289 |
| Human Foamy Virus | pGP12 | 1290 |
| Ebola Zaire Virus | pGP41 | 1291 |
| Dengue | pGP25 | 1292 |
| Zika virus | pGP26 | 1293 |
| West Nile Virus | pGP27 | 1294 |
| Japanese Encephalitis Virus | pGP28 | 1295 |
| Mumps Virus F | pGP31.1 | 1296 |

TABLE 66-continued

Plasmid sequences for structural plasmids and glycoproteins

| XDP version number/<br>Viral source | Plasmid<br>number | SEQ ID NO |
|---|---|---|
| Mumps Virus HN | pGP31.2 | 1297 |
| Sendai Virus F | pGP33.1 | 1298 |
| Sendai Virus HN | pGP33.2 | 1299 |
| AcMNPV gp64 | pGP59 | 1300 |
| Ross River Virus | pGP54 | 1301 |
| N1 Neuraminidase | pGP82 | 1302 |
| Dengue virus 2 | pGP75 | 1303 |
| Dengue virus 3 | pGP76 | 1304 |
| Dengue virus 4 | pGP77 | 1305 |
| Nipah Virus | pGP34.1 | 1306 |
| Nipah Virus | pGP34.2 | 1307 |
| Hendra Virus | pGP35.1 | 1308 |
| Hendra Virus | pGP35.2 | 1309 |
| Newcastle disease virus | pGP37.1 | 1310 |
| Newcastle disease virus | pGP37.2 | 1311 |

Guide Plasmid Cloning

The guide plasmids used in these experiments were either pSG005 or pSG17. pSG17 has both the spacer 12.7 targeting tdTomato as well as the guide scaffold 226 that has the RRE/RBE element that has been described in previous examples. pSG005 has guide scaffold 174 along with the spacer 12.7 targeting tdTomato. To clone the targeting pSG005 and pSG17 we cloned the spacer 12.7 using the following protocol. The targeting spacer sequence DNA for the tdTomato targeting spacer 12.7 was ordered as single-stranded DNA (ssDNA) oligos (Integrated DNA Technologies) consisting of the targeting sequence (CTGCATTCTAGTTGTGGTTT, SEQ ID NO: 1018) and the reverse complement of this sequence. These two oligos were annealed together and cloned into a pSG plasmid with an alternate scaffold by Golden Gate assembly as described in Example 7, above. The resultant plasmids were sequenced using Sanger sequencing to ensure correct ligation.

pGP Glycoprotein Plasmid Cloning

Encoding sequences for glycoproteins derived from Togaviridae, Paramyxoviridae, Rhabdoviridae, Orthomyxoviridae, Retroviridae and Flaviviridae are provided in Table 66. The designed constructs were synthesized as transgenes and purchased pre-cloned into pTWIST expression plasmids from Twist Biosciences. The resultant plasmids were sequenced using Sanger sequencing to ensure correct assembly (see Table 66).

Cell Culture and Transfection

HEK293T Lenti-X cell culture was performed as described in Example 7, above. XDPs derived from HIV lentiviral-based architecture (V168) were pseudotyped with GPs from Togaviridae (pGP65, 66, 67, 68, 69 and 70), Rhabdoviridae (pGP29.7, 30) and Moloney Murine leukemia virus (pGP10). XDPs derived from two different alpha retroviral-based architectures (ALV V44 and ALV V102) were pseudotyped with GPs from Rhabdoviridae (pGP29.7). For transfection, the XDP structural plasmids (configurations are listed in Table 66) were used in amounts ranging from 13 to 80.0 μg. Each transfection also received 13 μg of either pSG005 or pSG17 and 2.5 μs of pGP2 or any other GPs. Polyethylenimine (PEI Max from Polyplus) was then added as described in Example 7.

Collection and Concentration

XDPs were collected and concentrated as described in Example 8, above.

Resuspension and Transduction tdTomato neural progenitor cells were resuspended and transduced as described in Example 7, above, and tdTomato fluorescence was measured using flow cytometry. The assays were run 2-3 times for each sample with similar results.

Results:

Percent editing of the dtTomato target sequence in tdT NPCs are shown for all XDP constructs derived from HIV (V168) as well as XDP constructs derived from ALV (V44 and V102) in FIG. 65, in terms of volume of XDPs used to treat the cells. This is broken up further with the percent editing in tdT NPCs elicited when 50 μl and 16 μl of the concentrated XDP preps were used to treat NPCs, as shown in FIG. 66 and FIG. 67, respectively. Percent editing for the V168 XDPs pseudotyped with the different GPs, in terms of number of particles added to the tdTomato NPCs, are shown in FIG. 68. V168 pseudotyped with pGP2 served as the base control XDP for comparisons. The results show that GPs derived from Togaviridae (in particular Semliki, WEEV, EEEV, VEEV) and Rhabdoviridae (Mokola and Rabies), as well as MoMLV are potent in NPCs, suggesting properties of neural tropism. GPs derived from Togaviridae such as pGP68, pGP68, pGP66 and pGP65 seemed particularly potent (in that order) ranging in editing efficiencies from 74% to 36% when 50 μl of concentrated XDPs were used to treat NPCs. They also show that both architectural versions of ALV derived XDPs (V44 and V102) can be pseudotyped with GPs derived from Rhabdoviridae (pGP 29.7), ranging in editing efficacies from 7% to 27% when 50 μl of concentrated XDPs were used to treat NPCs, in addition to VSV-G, where they show efficacies ranging from 39% to 30% as shown in FIG. 67. Titers for the V168 XDPs were determined by P24 ELISA, as shown in FIG. 69, and they demonstrate that XDPs can be produced that are pseudotyped with the different glycoproteins without affecting overall titer. The difference in potency that is seen in tdTomato NPCs is most likely due to inherent differences in cellular and tissue tropism between these glycoproteins. The difference in editing profiles of ALV V44 and ALV102 pseudotyped with Rabies (pGP29.7) also highlights the possibility of the XDP internal architecture having an independent effect on the packaging of the targeting moiety on the surface of these particles. The lack of potencies with particular GPs such as pGP70 and pGP69 as compared to other Togaviridae GPs might be due to incompatibility with the internal architecture, in addition to inherent differences in tropism. Therefore, these GPs might show potency with other architectural variants of HIV based XDPs, in addition to XDPs derived from other architectural variants of Alpharetroviral, Betaretroviral, Gammaretroviral, Deltaretroviral, Epsilonretroviral, Lentiviral and Spumaretroviral origin.

XDPs derived from HIV lentiviral-based architecture (V168) were pseudotyped with GPs from different rabies variants from the Rhabdoviridae family (pGP29, 29.2, 29.3, 29.4, 29.5, 29.6, 29.8). V168 pseudotyped with pGP2 served as the base control XDP for comparisons. Several rabies variants showed potency in mouse NPCs, with pGP29 and pGP29.4 showing particular promise with editing efficiencies at the tDT locus ranging from 70% to 25% when 16.6 μl of the concentrated XDPs were used to treat NPCs, as shown in FIG. 70 and FIG. 71. V168 pseudotyped with pGP2 demonstrated the most efficacy at 85%. However, as compared to pGP2, the rabies variants (pGP29 and pGP29.4) would allow specific targeting of cells of neuronal origin, suggesting a better safety profile in vivo for neural indications, thereby making up for their lower editing potencies relative to VSV-G (pGP2).

XDPs derived from HIV lentiviral-based architecture (V168) were pseudotyped with GPs from Paramyxoviridae (pGP35.1, 35.2, 34.1, 34.2), Orthomyxoviridae (pGP80, 81, 82) and Flaviviridae (pGP25, 26, 27, 28, 75) families. Almost all the GPs showed activity at the 50 µl dose, as shown in FIG. 72. At the second dilution (when 16.6 µl of the concentrated XDPs were used to treat NPCs), XDPs pseudotyped with Orthomyxoviridae (pGP80, 82) and Paramyxoviridae (pGP35.1, 35.2, 34.1, 34.2) demonstrated about 35%, 11% and 10% editing, respectively, as shown in FIG. 73. Titers for the V168 XDPs were determined by P24 ELISA as shown in FIG. 74 and demonstrate that pseudotyping XPDs with the different glycoproteins didn't affect production titers.

These data support the conclusion that XDPs can be effectively pseudotyped with different glycoproteins derived from diverse viral genera. The differences in potency that were seen in tdTomato (tdT) NPCs suggests inherent differences in cellular and tissue tropism properties that exist amongst these glycoproteins. The observed selectively can be harnessed with XDPs designed to safely and selectively deliver the payload to therapeutically-relevant cells. Overall, these results show that XDPs can be engineered to possess selective cell tropism by effectively pseudotyping them with envelope glycoproteins derived from different viral families to produce potent particles. Given that V168 XDPs have been successfully pseudotyped with these diverse glycoproteins, it should be possible to use these glycoproteins to pseudotype other versions of XDPs derived from any architectural variants of Alpharetroviral, Betaretroviral, Gammaretroviral, Deltaretroviral, Epsilonretroviral, Lentiviral and Spumaretroviral origin.

Example 23: Enhancing Tropism and Editing Potency with Glycoproteins from Diverse Viruses The purpose of these experiments will be to create and evaluate XDP expressing glycoprotein from diverse viruses to determine their ability to confer tropism of the particles for certain cell, organ, or tissue types and to demonstrate the ability of such XDP to edit the target nucleic acid of the cells after successful delivery of the incorporated RNP into the target cells. Using the methodology of Examples 21 and 22 and the sequences of Table 9, glycoproteins from architectural variants of Alpharetroviral, Betaretroviral, Gammaretroviral, Deltaretroviral, Epsilonretroviral, Lentiviral and Spumaretroviral origin will be cloned into XDP, configured as V206, and the resulting particles will be evaluated by the methods for the ability to transfect and edit the target nucleic acid of cells, such as NPCs or cells from different tissues. The sequences of the glycoproteins to be evaluated by these methods are presented in Table 67. It is expected that some of the XDP created by these methods will have the capability to successfully transfect the cells and edit the target nucleic acid

TABLE 67

Glycoprotein sequences

| Virus | Glycoprotein Amino Acid SEQ ID NO |
|---|---|
| Vesicular Stomatitis Virus | 573 |
| Human Immunodeficiency Virus | 574 |
| Avian leukosis virus | 575 |
| Rous Sarcoma Virus | 576 |
| Mouse mammary tumor virus | 577 |
| Human T-lymphotropic virus 1 | 578 |
| RD114 Endogenous Feline Retrovirus | 579 |
| Gibbon ape leukemia virus | 580 |
| Moloney Murine leukemia virus | 581 |
| Baboon Endogenous Virus | 582 |
| Human Foamy Virus | 583 |
| Pseudorabies virus | 584 |
| Pseudorabies virus | 585 |
| Pseudorabies virus | 586 |
| Pseudorabies virus | 587 |
| Herpes simplex virus 1 (HHV1) | 588 |
| Herpes simplex virus 1 (HHV1) | 589 |
| Herpes simplex virus 1 (HHV1) | 590 |
| Herpes simplex virus 1 (HHV1) | 591 |
| Hepatitis C Virus | 592 |
| Rabies Virus | 593 |
| Mokola Virus | 594 |
| Measles Virus | 595 |
| Measles Virus | 596 |
| Ebola Zaire Virus | 597 |
| Dengue | 598 |
| Zika virus | 599 |
| West Nile Virus | 600 |
| Japanese Encephalitis Virus | 601 |
| Hepatitis G Virus | 602 |
| Mumps Virus F | 603 |
| Mumps Virus HN | 604 |
| Sendai Virus F | 605 |
| Sendai Virus HN | 606 |
| AcMNPV gp64 | 607 |
| Ross River Virus | 608 |
| Codon optimized rabies virus | 609 |
| Rabies virus (strain Nishigahara RCEH) (RABV) | 610 |
| Rabies virus (strain India) (RABV) | 611 |
| Rabies virus (strain CVS-11) (RABV) | 612 |
| Rabies virus (strain ERA) (RABV) | 613 |
| Rabies virus (strain SAD B19) (RABV) | 614 |
| Rabies virus (strain Vnukovo-32) (RABV) | 615 |
| Rabies virus (strain Pasteur vaccins/PV) (RABV) | 616 |
| Rabies virus (strain PM1503/AVO1) (RABV) | 617 |
| Rabies virus (strain China/DRV) (RABV) | 618 |
| Rabies virus (strain China/MRV) (RABV) | 619 |
| Rabies virus (isolate Human/Algeria/1991) (RABV) | 620 |
| Rabies virus (strain HEP-Flury) (RABV) | 621 |
| Rabies virus (strain silver-haired bat-associated) (RABV) (SHBRV) | 622 |
| HSV2 gB | 623 |
| HSV2 gD | 624 |
| HSV2 gH | 625 |
| HSV2 gL | 626 |
| Varicella gB | 627 |
| Varicella gK | 628 |
| Varicella gH | 629 |
| Varicella gL | 630 |
| Hepatitis B gL | 631 |
| Hepatitis B gM | 632 |
| Hepatitis B gS | 633 |
| Eastern equine encephalitis virus (EEEV) | 634 |
| Venezuelan equine encephalitis viruses (VEEV) | 635 |
| Western equine encephalitis virus (WEEV) | 636 |
| Semliki Forest virus | 637 |
| Sindbis virus | 638 |
| Chikungunya virus (CHIKV) | 639 |
| Bornavirus BoDV-1 | 640 |
| Tick-borne encephalitis virus (TBEV) | 641 |

TABLE 67-continued

Glycoprotein sequences

| Virus | Glycoprotein Amino Acid SEQ ID NO |
|---|---|
| Usutu virus | 642 |
| St. Louis encephalitis virus | 643 |
| Yellow fever virus | 644 |
| Dengue virus 2 | 645 |
| Dengue virus 3 | 646 |
| Dengue virus 4 | 647 |
| Murray Valley encephalitis virus (MVEV) | 648 |
| Powassan virus | 649 |
| H5 Hemagglutinin | 650 |
| H7 Hemagglutinin | 651 |
| N1 Neuraminidase | 652 |
| Canine Distemper Virus | 653 |
| VSAV | 654 |
| ABVV | 655 |
| CARV | 656 |
| CHPV | 657 |
| COCV | 658 |
| VSIV | 659 |
| ISFV | 660 |
| JURV | 661 |
| MSPV | 662 |
| MARV | 663 |
| MORV | 664 |
| VSNJV | 665 |
| PERV | 666 |
| PIRYV | 667 |
| RADV | 668 |
| YBV | 669 |
| VSV CEN AM-94GUB | 670 |
| VSV South America 85CLB | 671 |
| Nipah Virus | 672 |
| Nipah Virus | 673 |
| Hendra Virus | 674 |
| Hendra Virus | 675 |
| Newcastle disease virus | 676 |
| Newcastle disease virus | 677 |
| RSVf0 | 678 |
| RSVG | 679 |
| Bovine respiratory syncytial virus (strain Rb94) (BRS) | 680 |
| Murine pneumonia virus (strain 15) (MPV) | 681 |
| Measles virus (strain Edmonston) (MeV) (Subacute sclerose panencephalitis virus) | 682 |
| Measles virus (strain Edmonston B) (MeV) (Subacute sclerose panencephalitis virus) | 683 |
| Human respiratory syncytial virus B (strain B1) | 684 |
| Rinderpest virus (strain RBOK) (RDV) | 685 |
| Simian virus 41 (SV41) | 686 |
| Mumps virus (strain Miyahara vaccine) (MuV) | 687 |
| Canine distemper virus (strain Onderstepoort) (CDV) | 688 |
| Human respiratory syncytial virus A (strain Long) | 689 |
| Sendai virus (strain Fushimi) (SeV) | 690 |
| Human respiratory syncytial virus A (strain RSS-2) | 691 |
| Rinderpest virus (strain RBT1) (RDV) | 692 |
| Measles virus (strain Leningrad-16) (MeV) (Subacute sclerose panencephalitis virus) | 693 |
| Human parainfluenza 2 virus (HPIV-2) | 694 |
| Avian metapneumovirus (isolate Canada goose/Minnesota/15a/2001) (AMPV) | 695 |
| Phocine distemper virus (PDV) | 696 |
| Sendai virus (strain Harris) (SeV) | 697 |
| Bovine parainfluenza 3 virus (BPIV-3) | 698 |
| Measles virus (strain Ichinose-B95a) (MeV) (Subacute sclerose panencephalitis virus) | 699 |
| Human parainfluenza 2 virus (strain Toshiba) (HPIV-2) | 700 |
| Newcastle disease virus (strain B1-Hitchner/47) (NDV) | 701 |
| Measles virus (strain Yamagata-1) (MeV) (Subacute sclerose panencephalitis virus) | 702 |
| Measles virus (strain IP-3-Ca) (MeV) (Subacute sclerose panencephalitis virus) | 703 |
| Measles virus (strain Edmonston-AIK-C vaccine) (MeV) (Subacute sclerose panencephalitis virus) | 704 |
| Turkey rhinotracheitis virus (TRTV) | 705 |
| Human parainfluenza 2 virus (strain Greer) (HPIV-2) | 706 |
| Hendra virus (isolate Horse/Autralia/Hendra/1994) | 707 |
| Human metapneumovirus (strain CAN97-83) (HMPV) | 708 |
| Bovine respiratory syncytial virus (strain Copenhagen) (BRS) | 709 |
| Sendai virus (strain Z) (SeV) (Sendai virus (strain HVJ)) | 710 |
| Human parainfluenza 3 virus (strain Wash/47885/57) (HPIV-3) (Human parainfluenza 3 virus (strain NIH 47885)) | 711 |
| Mumps virus (strain SBL-1) (MuV) | 712 |
| Measles virus (strain Edmonston-Zagreb vaccine) (MeV) (Subacute sclerose panencephalitis virus) | 713 |
| Human parainfluenza 1 virus (strain C39) (HPIV-1) | 714 |
| Sendai virus (strain Hamamatsu) (SeV) | 715 |
| Mumps virus (strain RW) (MuV) | 716 |
| Infectious hematopoietic necrosis virus (strain Oregon69) (IHNV) | 717 |
| Drosophila melanogaster sigma virus (isolate Drosophila/USA/AP30/2005) (DMelSV) | 718 |
| Hirame rhabdovirus (strain Korea/CA 9703/1997) (HIRRV) | 719 |
| Sonchus yellow net virus (SYNV) | 720 |
| European bat lyssavirus 1 (strain Bat/Germany/RV9/1968) (EBLV1) | 721 |
| Lagos bat virus (LBV) | 722 |
| Duvenhage virus (DUVV) | 723 |
| West Caucasian bat virus (WCBV) | 724 |
| European bat lyssavirus 2 (strain Human/Scotland/RV 1333/2002) (EBLV2) | 725 |
| Irkut virus (IRKV) | 726 |
| Tupaia virus (isolate Tupaia/Thailand/-/1986) (TUPV) | 727 |
| Rabies virus (strain ERA) (RABV) | 728 |
| Ovine respiratory syncytial virus (strain WSU 83-1578) (ORSV) | 729 |
| Human respiratory syncytial virus A (strain rsb5857) | 730 |
| Piry virus (PIRYV) | 731 |
| Human respiratory syncytial virus A (strain rsb6190) | 732 |
| Rabies virus (strain SAD B19) (RABV) | 733 |
| Australian bat lyssavirus (isolate Human/AUS/1998) (ABLV) | 734 |
| Rabies virus (strain Vnukovo-32) (RABV) | 735 |
| Aravan virus (ARAV) | 736 |
| Sigma virus | 737 |
| Viral hemorrhagic septicemia virus (strain 07-71) (VHSV) | 738 |
| Rabies virus (strain Pasteur vaccins/PV) (RABV) | 739 |
| Bovine respiratory syncytial virus (strain Rb94) (BRS) | 740 |
| Tibrogargan virus (strain CS132) (TIBV) | 741 |
| Infectious hematopoietic necrosis virus (strain Round Butte) (IHNV) | 742 |
| Human respiratory syncytial virus B (strain 18537) | 743 |
| Adelaide River virus (ARV) | 744 |
| Australian bat lyssavirus (isolate Bat/AUS/1996) (ABLV) | 745 |
| Bovine ephemeral fever virus (strain BB7721) (BEFV) | 746 |
| Isfahan virus (ISFV) | 747 |

TABLE 67-continued

Glycoprotein sequences

| Virus | Glycoprotein Amino Acid SEQ ID NO |
|---|---|
| Rabies virus (strain silver-haired bat-associated) (RABV) (SHBRV) | 748 |
| Snakehead rhabdovirus (SHRV) | 749 |
| Infectious hematopoietic necrosis virus (strain WRAC) (IHNV) | 750 |
| Zaire ebolavirus (strain Kikwit-95) (ZEBOV) (Zaire Ebola virus) | 751 |
| Sudan ebolavirus (strain Maleo-79) (SEBOV) (Sudan Ebola virus) | 752 |
| Tai Forest ebolavirus (strain Cote d'Ivoire-94) (TAFV) (Cote d'Ivoire Ebola virus) | 753 |
| Reston ebolavirus (strain Philippines-96) (REBOV) (Reston Ebola virus) | 754 |
| Lake Victoria marburgvirus (strain Angola/2005) (MARV) | 755 |
| Zaire ebolavirus (strain Eckron-76) (ZEBOV) (Zaire Ebola virus) | 756 |
| Reston ebolavirus (strain Reston-89) (REBOV) (Reston Ebola virus) | 757 |
| Tai Forest ebolavirus (strain Cote d'Ivoire-94) (TAFV) (Cote d'Ivoire Ebola virus) | 758 |
| Lake Victoria marburgvirus (strain Ozolin-75) (MARV) (Marburg virus (strain South Africa/Ozolin/1975)) | 759 |
| Zaire ebolavirus (strain Mayinga-76) (ZEBOV) (Zaire Ebola virus) | 760 |
| Lake Victoria marburgvirus (strain Popp-67) (MARV) (Marburg virus (strain West Germany/Popp/1967)) | 761 |
| Sudan ebolavirus (strain Boniface-76) (SEBOV) (Sudan Ebola virus) | 762 |
| Reston ebolavirus (strain Reston-89) (REBOV) (Reston Ebola virus) | 763 |
| Sudan ebolavirus (strain Human/Uganda/Gulu/2000) (SEBOV) (Sudan Ebola virus) | 764 |
| Zaire ebolavirus (strain Gabon-94) (ZEBOV) (Zaire Ebola virus) | 765 |
| Reston ebolavirus (strain Reston-89) (REBOV) (Reston Ebola virus) | 766 |
| Simian virus 41 (SV41) | 767 |
| Newcastle disease virus (strain D26/76) (NDV) | 768 |
| Xenotropic MuLV-related virus (isolate VP42) (XMRV) | 769 |
| Xenotropic MuLV-related virus (isolate VP62) (XMRV) | 770 |
| Simian immunodeficiency virus (isolate F236/smH4) (SIV-sm) (Simian immunodeficiency virus sooty mangabey monkey) | 771 |
| Simian immunodeficiency virus (isolate Mm251) (SIV-mac) (Simian immunodeficiency virus rhesus monkey) | 772 |
| Simian immunodeficiency virus (isolate GB1) (SIV-mnd) (Simian immunodeficiency virus mandrill) | 773 |
| Simian immunodeficiency virus (isolate Mm 142-83) (SIV-mac) (Simian immunodeficiency virus rhesus monkey) | 774 |
| Simian immunodeficiency virus (isolate MB66) (SIV-cpz) (Chimpanzee immunodeficiency virus) | 775 |
| Simian immunodeficiency virus (isolate EK505) (SIV-cpz) (Chimpanzee immunodeficiency virus) | 776 |
| Feline immunodeficiency virus (strain UK2) (FIV) | 777 |
| Feline immunodeficiency virus (strain San Diego) (FIV) | 778 |
| Feline immunodeficiency virus (isolate Wo) (FIV) | 779 |
| Feline immunodeficiency virus (isolate Petaluma) (FIV) | 780 |
| Feline immunodeficiency virus (strain UK8) (FIV) | 781 |
| Feline immunodeficiency virus (strain UT-113) (FIV) | 782 |
| Mayoro Virus | 783 |
| Barmah Forest Virus | 784 |
| Aura virus | 785 |
| Bebaru Virus | 786 |
| Middleburg virus | 787 |
| Mucambo virus | 788 |
| Ndumu Virus | 789 |
| O'nyong-nyong virus | 790 |
| Pixuna virus | 791 |
| Tonate Virus | 792 |
| Trocara virus | 793 |
| Whataroa virus | 794 |
| Bussuquara virus | 795 |
| Jugra virus | 796 |

Example 24: Enhancing RNA Export Mechanisms for the Formation of XDP Using a Rev/RRE System—Scaffold 174 vs 226

The purpose of these experiments was to evaluate the effects of incorporation of a portion of an HIV-1 Rev response element (RRE) sequence into the guide RNA scaffold to determine whether RNA export, recruitment of the guide into XDP, and resultant potency of the XDP was enhanced, with and without a direct Gag-CasX fusion.

Methods:

All plasmids containing CasX proteins had the CasX variant 491 protein. All XDPs were pseudotyped with 10% VSV-G (percentage of plasmid relative to the other plasmids utilized for the XDP construct). RNA fold structures were generated with RNAfold web server and Varna java-based software.

Structural Plasmid Cloning

In order to generate the structural plasmids used to make the XDP, pXDP1 was digested using EcoRI to remove the Gag-pol sequence. Between one and three fragments containing CasX or HIV-1 Gag components were amplified and cloned as described in Example 7, above. The sequence for Rev was incorporated into the backbone of the Gag plasmid. The resultant plasmids were sequenced using Sanger sequencing to ensure correct assembly.

Guide Plasmid Cloning

The tdTomato and PTBP-1 targeting guide plasmids used in these experiments were pSG5, pSG17, pSG47, and pSG48 cloned from pSG3 for the first and pSG14 for the latter 3 plasmids. The mammalian expression backbone contained a cPPT, ampicillin resistance, and a colEI replication site and was amplified using primers with appropriate overlaps to accept the U6 promoter and guide RNA scaffold cassette. The backbone was digested using NdeI and XbaI. Synthetic DNA fragments corresponding to novel scaffolds were amplified and cloned as described in Example 7, above. The resultant plasmids, pSG3 and pSG5, were sequenced using Sanger sequencing to ensure correct assembly (see Table 68).

TABLE 68

Guide plasmids and sequences

| Plasmid number | Scaffold number | Target | Encoding Guide scaffold sequence | SEQ ID NO |
|---|---|---|---|---|
| pSG3 | 174 | NT | ACTGGCGCTTTTATCTGATTACTTTGAGAGCCATCACCAGCGACTATGTCGTAGTGGGTAAAGCTCCCTCTTCGGAGGGAGCATCAAAGCGAGACGTAATTACGTCTCG | 1021 |
| pSG4 | 174 | 12.2 | ACTGGCGCTTTTATCTGATTACTTTGAGAGCCATCACCAGCGACTATGTCGTAGTGGGTAAAGCTCCCTCTTCGGAGGGAGCATCAAAGTATAGCATACATTATACGAA | 1536 |
| pSG5 | 174 | 12.7 | ACTGGCGCTTTTATCTGATTACTTTGAGAGCCATCACCAGCGACTATGTCGTAGTGGGTAAAGCTCCCTCTTCGGAGGGAGCATCAAAGCGAGACGTAATTACGTCTCG | 1021 |
| pSG30 | 174 | 28.10 | ACTGGCGCTTTTATCTGATTACTTTGAGAGCCATCACCAGCGACTATGTCGTAGTGGGTAAAGCTCCCTCTTCGGAGGGAGCATCAAAGCAGCGGGGATCCGACGAGCT | 1537 |
| pSG14 | 226 | 0.0 | ACTGGCGCTTTTATCTGATTACTTTGAGAGCCATCACCAGCGACTATGTCGTAGTGGGTAAAGCTGCACTATGGGCGCAGCGTCAATGACGCTGACGGTACAGGCCAGACAATTATTGTCTGGTATAGTGCAGCATCAAAGCGAGACGTAATTACGTCTCG | 1538 |
| pSG17 | 226 | 12.7 | ACTGGCGCTTTTATCTGATTACTTTGAGAGCCATCACCAGCGACTATGTCGTAGTGGGTAAAGCTGCACTATGGGCGCAGCGTCAATGACGCTGACGGTACAGGCCAGACAATTATTGTCTGGTATAGTGCAGCATCAAAGCTGCATTCTAGTTGTGGTTT | 1539 |
| pSG0047 | 226 | 12.2 | ACTGGCGCTTTTATCTGATTACTTTGAGAGCCATCACCAGCGACTATGTCGTAGTGGGTAAAGCTGCACTATGGGCGCAGCGTCAATGACGCTGACGGTACAGGCCAGACAATTATTGTCTGGTATAGTGCAGCATCAAAGTATAGCATACATTATACGAA | 1540 |
| pSG0048 | 226 | 28.10 | ACTGGCGCTTTTATCTGATTACTTTGAGAGCCATCACCAGCGACTATGTCGTAGTGGGTAAAGCTGCACTATGGGCGCAGCGTCAATGACGCTGACGGTACAGGCCAGACAATTATTGTCTGGTATAGTGCAGCATCAAAGCAGCGGGGATCCGACGAGCT | 1541 |

Cloning tdTomato Spacer 12.7 into pSG3 and pSG14

To clone the targeting plasmids from their respective non-targeting plasmids we cloned the spacers 12.7, 12.2, and 28.10 using the following protocol. The targeting spacer sequence DNA for the tdTomato targeting spacer 12.7 was ordered as single-stranded DNA (ssDNA) oligos (Integrated DNA Technologies) consisting of the targeting sequence (CTGCATTCTAGTTGTGGTTT, SEQ ID NO: 1018) and the reverse complement of this sequence. The targeting spacer sequence DNA for the tdTomato targeting spacer 12.2 was ordered as single-stranded DNA (ssDNA) oligos (Integrated DNA Technologies) consisting of the targeting sequence (TATAGCATACATTATACGAA, SEQ ID NO: 1541) and the reverse complement of this sequence. The targeting spacer sequence DNA for the PTBP-1 targeting spacer 28.10 was ordered as single-stranded DNA (ssDNA) oligos (Integrated DNA Technologies) consisting of the targeting sequence (CAGCGGGGATCCGACGAGCT, SEQ ID NO: 1542) and the reverse complement of this sequence. For each spacer the two oligos were annealed together and cloned into pSG3 or pSG14 by Golden Gate assembly, as described in Example 7, above. The resultant plasmids were sequenced using Sanger sequencing to ensure correct ligation.

pGP2 Glycoprotein Plasmid Cloning

Sequences encoding the VSV-G glycoprotein and the CMV promoter were amplified from pMD2.G (UC Berkeley) and cloned as described in Example 7, above. The resultant plasmids were sequenced using Sanger sequencing to ensure correct assembly.

Cell Culture and Transfection

HEK293T Lenti-X cell culture was performed as described in Example 7, above. For transfection, the XDP structural plasmids (also encoding the CasX variants) of Table 69 were used in amounts ranging from 13 to 80.0 pg. Each transfection also received 13 μg of p42.174.12.7 and 0.25 μg of pGP2. Polyethylenimine (PEI Max from Polyplus) was then added as described in Example 7. The XDP versions, architectures and plasmids utilized in the transfection are listed in Table 70.

TABLE 69

Architecture and pseudotyping plasmid sequences

| Plasmid number | Architecture | SEQ ID NO of DNA SEQUENCE |
|---|---|---|
| pGP2 | VSV-G | 1003 |
| pXDP161* | Gag-(−1)-PR | (see Table 35 for pXDP161 sequence) |
| pXDP164* | Gag-MS2 | (see Table 35 for pXDP164 sequence) |
| pXDP166* | SV40NLS-CasX491-SV40 NLS | (see Table 35 for pXDP166 sequence) |
| pXDP17* | Gag-CasX491-HAtag | 1543 |

*Backbone of plasmid expressed Rev

TABLE 70

XDP version and pseudotyping descriptions

| XDP version | Architectures and glycoprotein | Plasmid numbers | Rev expression |
|---|---|---|---|
| 1 | Gag-(-1)-PR-RT-Int<br>Gag-CasX<br>VSV-G | pXDP1<br>pXDP17<br>pGP2 | Yes |
| 7 | Gag-CasX<br>VSV-G | pXDP17<br>pGP2 | No |
| 168 | Gag-(-1)-PR<br>Gag-CasX<br>VSV-G | pXDP161<br>pXDP17<br>pGP2 | Yes |
| 206 | Gag-MS2<br>Gag-(-1)-PR<br>CasX<br>VSV-G | pXDP164<br>pXDP161<br>pXDP166<br>pGP2 | Yes |
| 207 | Gag-(-1)-PR<br>CasX<br>VSV-G | pXDP161<br>pXDP166<br>pGP2 | Yes |

Collection and Concentration

XDPs were collected and concentrated as described in Example 8, above.

Resuspension and Transduction tdTomato neural progenitor cells were resuspended and transduced as described in Example 7, above. Editing of tdTomato was assessed by measuring fluorescence or by Next Generation Sequencing to assess rate of edits. The assays were run 2-3 times for each sample with similar results.

Results:

The HIV-1 Rev response element (RRE) is a ~350 nucleotide RNA element in the HIV-1 genome that is recognized by the HIV-1 Rev protein and is essential for HIV-1 replication. Early in the HIV-1 replication cycle, REV shuttles the HIV-1 RNA genome out of the nucleus into the cytoplasm by binding to the RRE, RanGTP, and Crm1. To enhance nuclear export of the sgRNAs into the cytoplasm of the XDP-producing LentiX cells, we incorporated portions of the RRE element into the extended stem region of the CasX scaffold 174. The RRE binds strongest to Rev at Stem II (circled in FIG. 75) and so this region was incorporated into scaffold 174 (FIG. 76). The resulting scaffold, scaffold 226, is depicted in FIG. 77.

Guide scaffold 226 was evaluated using three different spacer sequences; 12.7 (CTGCATTCTAGTTGTGGTTT, SEQ ID NO: 1018), 12.2 (TATAGCATACATTATACGAA, SEQ ID NO: 1541), targeting tdTomato, and 28.10 (CAGCGGGGATCCGACGAGCT, SEQ ID NO: 1542) targeting PTBP-1. Editing using spacers 12.7 and 12.2 were read out using the tdTomato system and 28.10 was analyzed using NGS of the PTBP-1 locus. In each case, XDP incorporating scaffold 226 resulted in 3 to 5-fold greater editing per XDP than XDP incorporating scaffold 174 (Table 71).

TABLE 71

EC50 results from editing assays

| Spacer | EC50 174/EC50 226 |
|---|---|
| 12.7 | 3.06 |
| 12.2 | 5.31 |
| 28.10 | 3.64 |

To further interrogate the mechanism of the increases in potency using the RRE/Rev system, we performed three assays. First, we demonstrated that the increase in potency is Rev-dependent by testing the 226 guide scaffold in the XDP V1 and V7 architectures. Plasmids in the V1 architecture encode the Rev protein whereas the Rev protein is absent in the V7 architecture. FIG. 104 demonstrates that editing with XDP incorporating scaffold 174 or scaffold 226 is very similar in the V7 architecture; scaffold 226 does not increase editing in the Rev-independent V7 construct but does in V1, a Rev-containing architecture.

Next, we assessed the efficiency of scaffold 226 in the absence of an additional recruitment system (e.g., Gag-CasX fusion, Gag-MS2, tVSVG-Stx). XDP version 207 lacks any architectural recruitment mechanism for CasX to be incorporated into the XDP. XDPs with guide scaffold 174 were unable to edit NPCs in this construct whereas XDPs with scaffold 226 were able to achieve >20% editing (FIG. 105). These data suggest that there may be an orthogonal mechanism of recruitment effected by guide scaffold 226, especially since the increase in editing is greater than was seen in the V168 and V1 XDPs.

Lastly, we assessed the edits made by XDP with guide scaffold 174 and 226 to ensure that the nature of edits caused by the RNP was preserved across these two scaffolds. NGS data from samples from the constructs evaluated in FIG. 106 were run through CRISPResso to assess the indel profile. Insertions and deletions were graphed by their frequency on the total read population. Analysis of the data showed that the proportion of insertions and deletions remained similar across the two scaffolds. FIG. 107 shows the data for the calculated EC50 values for the editing experiments.

The editing data with XDP incorporating guide scaffold 226 demonstrate a consistent pattern of increased potency over XDP incorporating guide scaffold 174. The data show that without changing the nuclease function, the potency of XDPs can be increased by designing constructs that incorporate an RNA nuclear export pathway such as the Rev/RRE system. These enhanced effects were seen across different gene targets and multiple spacers.

The data demonstrate the utility of incorporating retroviral RNA transport elements into the RNP scaffold to increase potency of XDP particles.

Example 25: Enhancing Export Mechanisms for the Formation of XDP—Scaffold 226 Incorporating RRE Variants The purpose of these experiments was to evaluate the effects of incorporating portions of the HIV-1 Rev response element (RRE) into guide scaffolds to enhance transport of the guides and associated RNPs for increased incorporation into XDPs, thereby increasing their potency.

Here, we show that we can incorporate a more minimal portion of the RRE, termed "RBE", into the guide scaffold to achieve greater potency. We also show that guide scaffold 226, which contains RRE stem II, can be modified to include other RNA elements without sacrificing potency.

Methods:

All plasmids containing CasX proteins had the CasX variant 491 protein. All XDPs were pseudotyped with 10% VSV-G (percentage of plasmid relative to the other plasmids utilized for the XDP construct). RNA fold structures were generated with RNAfold web server and Varna java-based software.

Structural Plasmid Cloning

In order to generate the structural plasmids used to make the XDP, pXDP1 was digested using EcoRI to remove the Gag-pol sequence. Between one and three fragments containing CasX or HIV-1 components were amplified and cloned as described in Example 7, above. The resultant plasmids were sequenced using Sanger sequencing to ensure correct assembly.

Guide Plasmid Cloning

The tdTomato targeting guide plasmids used in these experiments were pSG5, pSG17, pSG65, and pSG72 to pSG76 cloned from non-targeting plasmids pSG3, pSG14, pSG13, and pSG67 to pSG71 respectively. The sequences of these plasmids and the inserted RRE elements can be found in Table 72 below. The mammalian expression backbone contained a cPPT, ampicillin resistance, and a colEI replication site and was amplified using primers with appropriate overlaps to accept the U6 promoter and guide RNA scaffold cassette. The backbone was digested using NdeI and XbaI. Synthetic DNA fragments corresponding to novel scaffolds were amplified and cloned as described in Example 7, above. The resultant plasmids, pSG3 and pSG5, were sequenced using Sanger sequencing to ensure correct assembly (see Table 72).

TABLE 72

Guide plasmids and sequences

| Plasmid number | Scaffold number | Target | Guide scaffold DNA sequence | SEQ ID NO |
|---|---|---|---|---|
| pSG3 | 174 | 0.0 | ACTGGCGCTTTTATCTGATTACTTTGAGAGCCATCACCAGCGAC<br>TATGTCGTAGTGGGTAAAGCTCCCTCTTCGGAGGGAGCATCAAA<br>GCGAGACGTAATTACGTCTCG | 1021 |
| pSG5 | 174 | 12.7 | ACTGGCGCTTTTATCTGATTACTTTGAGAGCCATCACCAGCGAC<br>TATGTCGTAGTGGGTAAAGCTCCCTCTTCGGAGGGAGCATCAAA<br>GCGAGACGTAATTACGTCTCG | 1021 |
| pSG14 | 226 | 0.0 | ACTGGCGCTTTTATCTGATTACTTTGAGAGCCATCACCAGCGAC<br>TATGTCGTAGTGGGTAAAGCTGCACTATGGGCGCAGCGTCAATG<br>ACGCTGACGGTACAGGCCAGACAATTATTGTCTGGTATAGTGCA<br>GCATCAAAGCGAGACGTAATTACGTCTCG | 1538 |
| pSG16 | 227 | 0.0 | ACTGGCGCTTTTATCTGATTACTTTGAGAGCCATCACCAGCGAC<br>TATGTCGTAGTGGGTAAAGCTAGGAGCTTTGTTCCTTGGGTTCT<br>TGGGAGCAGCAGGAAGCACTATGGGCGCAGCGTCAATGACGCTG<br>ACGGTACAGGCCAGACAATTATTGTCTGGTATAGTGCAGCAGCA<br>GAACAATTTGCTGAGGGCTATTGAGGCGCAACAGCATCTGTTGC<br>AACTCACAGTCTGGGGCATCAAGCAGCTCCAGGCAAGAATCCTG<br>GCTGTGGAAAGATACCTAAAGGATCAACAGCTCCTAGCATCAAA<br>GCGAGACGTAATTACGTCTCG | 1544 |
| pSG17 | 226 | 12.7 | ACTGGCGCTTTTATCTGATTACTTTGAGAGCCATCACCAGCGAC<br>TATGTCGTAGTGGGTAAAGCTGCACTATGGGCGCAGCGTCAATG<br>ACGCTGACGGTACAGGCCAGACAATTATTGTCTGGTATAGTGCA<br>GCATCAAAGCTGCATTCTAGTTGTGGTTT | 1539 |
| pSG18 | 227 | 12.7 | ACTGGCGCTTTTATCTGATTACTTTGAGAGCCATCACCAGCGAC<br>TATGTCGTAGTGGGTAAAGCTAGGAGCTTTGTTCCTTGGGTTCT<br>TGGGAGCAGCAGGAAGCACTATGGGCGCAGCGTCAATGACGCTG<br>ACGGTACAGGCCAGACAATTATTGTCTGGTATAGTGCAGCAGCA<br>GAACAATTTGCTGAGGGCTATTGAGGCGCAACAGCATCTGTTGC<br>AACTCACAGTCTGGGGCATCAAGCAGCTCCAGGCAAGAATCCTG<br>GCTGTGGAAAGATACCTAAAGGATCAACAGCTCCTAGCATCAAA<br>GCTGCATTCTAGTTGTGGTTT | 1545 |
| pSG67 | 250 | 0.0 | ACTGGCGCTTTTATCTGATTACTTTGAGAGCCATCACCAGCGAC<br>TATGTCGTAGTGGGTAAAGCTGCACTATGGGCGCAGCGTCAATG<br>ACGCTGACGGTACAGGCCACATGAGGATCACCCATGTGGTATAG<br>TGCAGCATCAAAGCGAGACGTAATTACGTCTCG | 1200 |
| pSG68 | 251 | 0.0 | ACTGGCGCTTTTATCTGATTACTTTGAGAGCCATCACCAGCGAC<br>TATGTCGTAGTGGGTAAAGCTGCACTATGGGCGCAGCTCATGAG<br>GATCACCCATGAGCTGACGGTACAGGCCACATGAGGATCACCCA<br>TGTGGTATAGTGCAGCATCAAAGCGAGACGTAATTACGTCTCG | 1201 |
| pSG69 | 252 | 0.0 | ACTGGCGCTTTTATCTGATTACTTTGAGAGCCATCACCAGCGAC<br>TATGTCGTAGTGGGTAAAGCTGCACTATGGGCGCAGCGTCAATG<br>ACGCTGACGGTACAGGCCACATGGCAGTCGTAACGACGCGGGTG<br>GTATAGTGCAGCATCAAAGCGAGACGTAATTACGTCTCG | 1227 |
| pSG70 | 253 | 0.0 | ACTGGCGCTTTTATCTGATTACTTTGAGAGCCATCACCAGCGAC<br>TATGTCGTAGTGGGTAAAGCTGCACTATGGGCGCAGCAAACATG<br>GCAGTCCTAAGGACGCGGGTTTTGCTGACGGTACAGGCCACATG<br>GCAGTCGTAACGACGCGGGTGGTATAGTGCAGCATCAAAGCGAG<br>ACGTAATTACGTCTCG | 1546 |
| pSG71 | 254 | 0.0 | ACTGGCGCTTTTATCTGATTACTTTGAGAGCCATCACCAGCGAC<br>TATGTCGTAGTGGGTAAAGCTGCACTATGGGCGCAGACATGGCA<br>GTCGTAACGACGCGGGTCTGACGGTACAGGCCACATGAGGATCA<br>CCCATGTGGTATAGTGCAGCATCAAAGCGAGACGTAATTACGTC<br>TCG | 1547 |

TABLE 72-continued

Guide plasmids and sequences

| Plasmid number | Scaffold number | Target | Guide scaffold DNA sequence | SEQ ID NO |
|---|---|---|---|---|
| pSG72 | 250 | 12.7 | ACTGGCGCTTTTATCTGATTACTTTGAGAGCCATCACCAGCGACTATGTCGTAGTGGGTAAAGCTGCACTATGGGCGCAGCGTCAATGACGCTGACGGTACAGGCCACATGAGGATCACCCATGTGGTATAGTGCAGCATCAAAGCTGCATTCTAGTTGTGGTTT | 1202 |
| pSG73 | 251 | 12.7 | ACTGGCGCTTTTATCTGATTACTTTGAGAGCCATCACCAGCGACTATGTCGTAGTGGGTAAAGCTGCACTATGGGCGCAGCTCATGAGGATCACCCATGAGCTGACGGTACAGGCCACATGAGGATCACCCATGTGGTATAGTGCAGCATCAAAGCTGCATTCTAGTTGTGGTTT | 1203 |
| pSG74 | 252 | 12.7 | ACTGGCGCTTTTATCTGATTACTTTGAGAGCCATCACCAGCGACTATGTCGTAGTGGGTAAAGCTGCACTATGGGCGCAGCGTCAATGACGCTGACGGTACAGGCCACATGGCAGTCGTAACGACGCGGGTGGTATAGTGCAGCATCAAAGCTGCATTCTAGTTGTGGTTT | 1229 |
| pSG75 | 253 | 12.7 | ACTGGCGCTTTTATCTGATTACTTTGAGAGCCATCACCAGCGACTATGTCGTAGTGGGTAAAGCTGCACTATGGGCGCAGCAAACATGGCAGTCCTAAGGACGCGGGTTTTGCTGACGGTACAGGCCACATGGCAGTCGTAACGACGCGGGTGGTATAGTGCAGCATCAAAGCTGCATTCTAGTTGTGGTTT | 1548 |
| pSG76 | 254 | 12.7 | ACTGGCGCTTTTATCTGATTACTTTGAGAGCCATCACCAGCGACTATGTCGTAGTGGGTAAAGCTGCACTATGGGCGCAGACATGGCAGTCGTAACGACGCGGGTCTGACGGTACAGGCCACATGAGGATCACCCATGTGGTATAGTGCAGCATCAAAGCTGCATTCTAGTTGTGGTTT | 1230 |

Cloning tdTomato Spacer 12.7 into pSG3, pSG14, pSG13, and pSG67 to pSG71

The targeting spacer sequence DNA for the tdTomato targeting spacer 12.7 was ordered as single-stranded DNA (ssDNA) oligos (Integrated DNA Technologies), consisting of the targeting sequence (CTGCATTCTAGTTGTGGTTT, SEQ ID NO: 1018) and the reverse complement of this sequence. These two oligos were annealed together and cloned into the non-targeting (CGAGACGTAAT-TACGTCTCG, SEQ ID NO: 1019) scaffold plasmids. This was done by Golden Gate assembly, as described in Example 7, above. The resultant plasmids were sequenced using Sanger sequencing to ensure correct ligation.

pGP2 Glycoprotein Plasmid Cloning

Sequences encoding the VSV-G glycoprotein and the CMV promoter were amplified from pMD2.G (UC Berkeley) using Kapa HiFi DNA polymerase according to the manufacturer's protocols and primers appropriate for In-Fusion cloning. The backbone was taken from a kanamycin resistant plasmid and amplified and cloned using the same methods. These were purified by gel extraction from a 1% agarose gel using Zymoclean Gel DNA Recovery Kit according to the manufacturer's protocol. These fragments were cloned into plasmid backbones using In-Fusion® HD Cloning Kit from Takara according to manufacturer protocols. Assembled products were transformed into chemically-competent Turbo Competent E. coli bacterial cells, plated on LB-Agar plates containing kanamycin and incubated at 37° C. Individual colonies were picked and miniprepped using Qiagen spin Miniprep Kit following the manufacturer's protocol. The resultant plasmids were sequenced using Sanger sequencing to ensure correct assembly (see Table 73).

TABLE 73

XDP architecture and pseudotyping plasmid sequences

| Plasmid number | Architecture | DNA encoding sequence |
|---|---|---|
| pGP2 | VSV-G | 1003 |
| pXDP161* | Gag-(-1)-PR | (see Table 35 for pXDP161 sequence) |
| pXDP166* | SV40NLS-CasX491-SV40 NLS | (see Table 35 for pXDP166 sequence) |
| pXDP17 | Gag-CasX491-HAtag | 1549 |

*backbone of plasmid expresses REV

Cell Culture and Transfection

HEK293T Lenti-X cell culture was performed as described in Example 7, above. For transfection, the XDP structural plasmids (also encoding the CasX variants) of Table 74 were used in amounts ranging from 13 to 80.0 pg. Each transfection also received 13 μg of p42.174.12.7 and 0.25 μg of pGP2. Polyethylenimine (PEI Max from Polyplus) was then added as described in Example 7.

TABLE 74

XDP Version descriptions

| XDP version | Architectures | Plasmid numbers | Rev expression |
|---|---|---|---|
| 1 | Gag-(-1)-PR-RT-Int Gag-CasX VSV-G | pXDP1 pXDP17 pGP2 | Yes |
| 7 | Gag-CasX VSV-G | pXDP17 pGP2 | No |
| 168 | Gag-(-1)-PR Gag-CasX VSV-G | pXDP161 pXDP17 pGP2 | Yes |

Collection and Concentration

XDPs were collected and concentrated as described in Example 8, above.

Resuspension and Transduction tdTomato neural progenitor cells were resuspended and transduced as described in Example 7, above, and tdTomato fluorescence was measured using flow cytometry. The assays were run 2-3 times for each sample with similar results.

Results:

In the previous Example 24, we demonstrated insertion of a portion of the HIV-1 Rev response element (RRE) into the extended stem of guide scaffold 174 can result in more potent XDP particles through REV-mediated export of the RRE containing sgRNA from the nucleus to the cytoplasm in producer cells. This guide scaffold, 226, contained stem II of the RRE and enhanced XDP potency 3 to 5-fold over guide scaffold 174 lacking the RRE fragment. Here, we demonstrate that a subset of stem IIB, termed Rev binding element (RBE), is sufficient for this increased potency (scaffold 249; see Table 75). Using this information, four new scaffolds, 250 to 254, were created which contain multiple copies of the RBE, as well as other RNA-binding components. Other constructs were created (pSG36-pSG40) to contain between one and five of these minimal RBE components as concatemers.

TABLE 75

Titer and editing results of XDP version 168 incorporating scaffolds 226 or 249

| Scaffold | Titer (XDP/ml by nanosight) | Mean Size (nm) | Log EC50 |
| --- | --- | --- | --- |
| 226 | 3.51E+10 | 175 | 7.217 |
| 249 | 4.20E+10 | 170 | 7.130 |

The guide scaffold 226, described in the previous Example 27 and depicted in FIG. 77, enhances XDP potency over XDP incorporating scaffold 174 by increasing the nuclear export of sgRNA from the nucleus and, possibly, shuttling fully-formed RNP out of the nucleus. This function is mediated by the HIV-1 Rev protein (incorporated into the XDP construct) binding to the RRE portion of the scaffold. Scaffold 226 contains stem II of the RRE, shown in FIG. 75, which is the principle binding region of the RRE. We have found that incorporation of just stem IIB is sufficient for this increase in potency. Scaffold 249, shown in FIG. 79, is a built on scaffold 174 with just the RRE stem IIB swapped into the extended stem of the scaffold. The results depicted in FIG. 83 and FIG. 84 show that editing and potency (EC50) are very similar between scaffold 226 and 249 with spacer 12.7 in the tdTomato assay, and both showed a significant improvement over scaffold 174. Scaffold 227 was included in these experiments as well, but edited poorly; possibly due to the size of the insertion (FIG. 80).

After determining that stem IIB was sufficient for the increase in XDP potency, additional modifications of scaffold 226 were designed. We created 5 scaffolds that maintained the main REV binding region in Stem IIB and modified the left and right stem loops of the scaffold. The stem loops either had a Rev binding element (RBE), MS2 hairpin, or were unchanged. Results of the editing experiments revealed that these modifications and insertions had little effect on potency (see Table 76). Inserting multiple RBEs did not increase editing and replacing portions with the exogenous MS2 hairpin had no or very little effect on editing (however, no MS2 coat protein was present in any of these constructs, which was likely the reason for the lack of increased editing in those constructs). Results in FIG. 85 show that editing (both by volume and potency (EC50)) are very similar across all samples, with 253 being slightly less potent.

TABLE 76

Results of editing assays with guide scaffold constructs with RRE and MS2 components

| Scaffold | FIG. | Variant | Left loop | Right loop | Editing at 0.6 uL | Log EC50 |
| --- | --- | --- | --- | --- | --- | --- |
| 250 | 45 | 226 with one MS2HP | normal | MS2 HP | 54.3 | 7.311 |
| 251 | 46 | 226 with dual MS2HP | MS2 HP | MS2HP | 31.7 | |
| 252 | 81 | 226 with second RBE | normal | RBE | 29.5 | 7.437 |
| 253 | 82 | 226 with dual RBE | RBE | RBE | 15.3 | |
| 254 | 55 | 226 RBE + MS2 | RBE | MS2 | 46.2 | 7.217 |
| 226 | 77 | 174 with RRE Stem II | unmodified | unmodified | 42.2 | |

The results demonstrate that multiple configurations of guide scaffold 226 can be engineered with RRE components that enhance the potency of the resulting XDP. The scaffolds with the minimal RBE may serve as a new potential lead variant since it is more compact than other scaffolds, yet is similarly potent. Results from the variant scaffolds demonstrate the ability to incorporate recruiting elements into these scaffolds without sacrificing potency. It is anticipated that the incorporation into scaffold variants of more protein binding hairpin sequences (e.g., Qβ phage, retrovirus Tar, Csy4, Pardaxin, tRNA, GA phage, PP7 phage, Iron Responsive Element, A N, U1 hairpin II, PSI) or subcellular localization sequences such as the CTE would similarly enhance the potency of the resulting XDP.

Example 26: Evaluation of Nuclear Import and Export Systems—NLS Variants+/−RRE

The purpose of these experiments was to evaluate the effects on editing potency of the addition of NLS sequences to the N- and/or C-terminal end of CasX, RRE into guide RNA sequences, and Rev that are incorporated into XDP constructs.

RRE incorporated into guide RNA acts as a nuclear export signal in combination with the HIV REV element that is a part of the XDP production constructs, enabling more guide RNA/RNPs to be exported out of the nucleus and available to be packaged into budding XDPs. When we combined the RNPs with novel NLS variants with a guide RNA containing a minimal RRE element termed RBE, we discovered a synergistic effect in enhancing XDP editing potency. For these experiments, XDPs with the guide scaffold with RRE (pSG17, V168.226) and without RRE (pSG5, V168.174), along with incorporated NLS, were evaluated to assess the contributions of these components to editing efficiency. We also made XDPs without the VSV-G targeting moiety to address whether NLS can act as cell-penetrating peptides to mediate cell entry.

Methods

All plasmids containing CasX proteins encoded the CasX 491 variant protein. All XDPs were pseudotyped with 10% VSV-G (percentage of plasmid relative to the other plasmids utilized for the XDP construct). RNA fold structures were generated with RNAfold web server and Varna java-based software.

Structural Plasmid Cloning

In order to generate the structural plasmids used below, pXDP1 was digested using EcoRI to remove the Gag-pol sequence. Between one and three fragments containing the CasX 491 variant protein with the different NLS constructs, as shown in Table 79, and HIV-1 components were amplified and cloned as described in Example 7, above. The resultant plasmids were sequenced using Sanger sequencing to ensure correct assembly. The plasmids with the sequences and corresponding version numbers are listed in Table 78.

Guide Plasmid Cloning

The guide plasmids used in these experiments were either pSG005 or pSG17. pSG17 has both the spacer 12.7 targeting tdTomato as well as the scaffold 226 that has the RRE/RBE element (described in previous Examples herein). pSG005 has the scaffold 174 along with the spacer 12.7 targeting tdTomato. To clone the targeting pSG005 and pSG17 we cloned the spacer 12.7 using the following protocol. The targeting spacer sequence DNA for the tdTomato targeting spacer 12.7 was ordered as single-stranded DNA (ssDNA) oligos (Integrated DNA Technologies) consisting of the targeting sequence (CTGCATTCTAGTTGTGGTTT, SEQ ID NO: 1018) and the reverse complement of this sequence. These two oligos were annealed together and cloned into a pSG plasmid with an alternate scaffold by Golden Gate assembly as described in Example 7, above. The resultant plasmids were sequenced using Sanger sequencing to ensure correct ligation.

pGP2 Glycoprotein Plasmid Cloning

Sequences encoding the VSV-G glycoprotein and the CMV promoter were amplified from pMD2.G (UC Berkeley) and cloned as described in Example 7, above. The backbone was taken from a kanamycin resistant plasmid and amplified and cloned using the same methods. Assembled products were transformed into chemically-competent Turbo Competent E. coli bacterial cells, plated on LB-Agar plates containing kanamycin and incubated at 37° C. The resultant plasmids were sequenced using Sanger sequencing to ensure correct assembly.

Cell Culture and Transfection

HEK293T Lenti-X cell culture was performed as described in Example 7, above. Structural plasmid 1 for Version 168 (pXDP17), 303 (pXDP112), 304 (pXDP114), 305 (pXDP116), 306 (pXDP111), 307 (pXDP113), 308 (pXDP115), 309 (pXDP219), 310 (pXDP220), 211 (pXDP223), 212 (pXDP224), 213 (pXDP225), 214 (pXDP226), 215 (pXDP227), 216 (pXDP228), 217 (pXDP229), 218 (pXDP230), 219 (pXDP231), 220 (pXDP237), 221 (pXDP238), 222 (pXDP239), 223 (pXDP240), 224 (pXDP241), 225 (pXDP242), 226 (pXDP243), 227 (pXDP244), 228 (pXDP245), 229 (pXDP246), 230 (pXDP247), 231 (pXDP248), 232 (pXDP249), 233 (pXDP250), 234 (pXDP251), 235 (pXDP252), 236 (pXDP253), 237 (pXDP254), 238 (pXDP255), 239 (pXDP256), 246 (pXDP263), 247 (pXDP264), 248 (pXDP265), 249 (pXDP266), 250 (pXDP267), 251 (pXDP268), 252 (pXDP269), 253 (pXDP270), 254 (pXDP271), 283 (pXDP322), 284 (pXDP323), 285 (pXDP324), 286 (pXDP325), 287 (pXDP326), 288 (pXDP327), 289 (pXDP328), 290 (pXDP329), 291 (pXDP333) and 292 (pXDP334) are shown in parenthesis and they all encode for CasX 491 with different NLS. Structural plasmid 2 for all the versions is pXDP161. Structural plasmid-1, along with details about the N- and C-terminal NLS sequences, as well as structural plasmid-2 in addition to the other plasmid compositions of each XDP version is listed in Table 79. The guide plasmids used in these experiments were either pSG005 or pSG17. pSG17 has both the spacer 12.7 targeting tdTomato as well as scaffold 226. pSG005 has the scaffold 174 along with the spacer 12.7 targeting tdTomato. The GP plasmid was pGP2. For transfection, the XDP structural plasmids listed above and in Table 78 were used in amounts ranging from 13 to 80.0 µg. Each transfection also received 13 µg of pSG005 or pSG17 (gRNA) and 0.25 µg of pGP2. Polyethylenimine (PEI Max from Polyplus) was then added as described in Example 7.

Collection and Concentration

XDPs were collected and concentrated as described in Example 8, above.

Resuspension and Transduction tdTomato neural progenitor cells were resuspended and transduced as described in Example 7, above. tdTomato fluorescence was measured using flow cytometry. The assays were run 2-3 times for each sample with similar results.

Results:

Table 77 provides the percent editing in tdT NPCs treated with 0.02 µl or 0.008 µl of the concentrated XDP preps.

TABLE 77

Results of editing assay for first and second dilution

| XDP version | Plasmid number | Percent editing in mouse NPCs at 0.02 µl | Percent editing in mouse NPCs at 0.008 µl |
|---|---|---|---|
| 168 | pXDP17 | 11.2 | 6.72 |
|  |  | 11.8 | 6.51 |
| 303 | pXDP112 | 32.2 | 17.5 |
|  |  | 30.8 | 16.2 |
| 304 | pXDP114 | 33 | 19.4 |
|  |  | 32.6 | 19.8 |
| 305 | pXDP116 | 20.1 | 11.9 |
|  |  | 20.3 | 8.91 |
| 306 | pXDP111 | 13.1 | 8.48 |
|  |  | 12.4 | 7.97 |
| 307 | pXDP113 | 12.2 | 7.14 |
|  |  | 11.6 | 7.11 |
| 308 | pXDP115 | 17 | 12 |
|  |  | 16.8 | 11 |
| 219 | pXDP231 | 63 | 41.6 |
|  |  | 64.4 | 42.8 |
| 228 | pXDP245 | 78.2 | 62 |
|  |  | 75.6 | 59.8 |
| 231 | pXDP248 | 81.5 | 68.9 |
|  |  | 84.1 | 67.1 |
| 234 | pXDP251 | 58.8 | 42.8 |
|  |  | 58.7 | 42.9 |
| 235 | pXDP252 | 52 | 33.7 |
|  |  | 36.7 | 28.3 |
| 238 | pXDP255 | 85.6 | 74.9 |
|  |  | 88.8 | 76.9 |
| 239 | pXDP256 | 93.6 | 83.8 |
|  |  | 93.8 | 82.5 |
| 223 | pXDP240 | 84.2 | 69.2 |
|  |  | 82.4 | 66 |
| 246 | pXDP263 | 64.5 | 48.6 |
|  |  | 64.4 | 48.3 |
| 247 | pXDP264 | 79.6 | 62.7 |
|  |  | 78.9 | 60.7 |
| 249 | pXDP266 | 62.4 | 41.1 |
|  |  | 57.5 | 41.6 |
| 250 | pXDP267 | 75 | 50.9 |
|  |  | 74.4 | 50.2 |
| 252 | pXDP269 | 57.4 | 41.7 |
|  |  | 54.6 | 40.5 |
| 230 | pXDP247 | 56.3 | 41.7 |
|  |  | 52.7 | 41.7 |

As compared to our base control V168-pXDP17 where the CasX 491 protein is flanked by an SV40 NLS on the N- and the C-terminal, 18 out of 20 of the NLS variants showed improvements in editing. In particular, V238-pXDP255 (93.7%), V239-pXDP256 (87.2%), V223-pXDP240 (83.3%), V231-pXDP248 (82.8%), V247-pXDP264 (79.3%), V228-pXDP245 (76.9%), V250-pXDP267 (74.7%), V246-pXDP263 (64.5%) showed significant improvement in editing potency as compared to V168-pXDP17 (11.5%) at the treatment dose of 0.02 µl. These XDPs were produced with scaffold 226 (pSG17).

EC50 for the different constructs were calculated and plotted as shown in FIG. 87. Almost all variants demonstrated improved potency; in particular V238-pXDP255 (2.1e+004), V239-pXDP256 (7.83e+005), V223-pXDP240 (8.9e+004), V231-pXDP248 (1.5e+006), V247-pXDP264 (8.0e+005), V228-pXDP245 (1.5e+005), V250-pXDP267 (4.8e+005), V246-pXDP263 (1.3e+006), V252-pXDP269 (2.3e+005) showed significant improvement in editing potency as compared to V168-pXDP17 (3.2e+006) as demonstrated by their EC50 values. In addition, the fold change in EC50s across the different constructs as compared to the base control XDP construct is shown in FIG. 88. Reiterating what has been observed before, almost all the constructs showed fold change improvements in EC50 over the control V168-pXDP17. In particular, V238-pXDP255 demonstrated more than 100-fold improvement in potency as compared to V168-pXDP17. V252-pXDP269, V223-pXDP240, V235-pXDP252, V228-pXDP245 showed between 20 and 100-fold improvement in potency as compared to V168-pXDP17. V230-pXDP247, V250-pXDP267, V247-pXDP264, V239-pXDP256, V234-pXDP251, V219-pXDP231 and V304-pXDP114 showed close to 10-fold improvement in potency as compared to V168-pXDP17. The results show that the editing potency of CasX RNPs can be vastly improved, with more than a 100-fold improvement) by engineering the NLS construct designs on the N- and C-termini.

We then selected the top XDP versions—V238-pXDP255, V223-pXDP240, V228-pXDP245, V239-pXDP256, V252-pXDP269, V231-pXDP248 and V308-pXDP115 and produced them with guide scaffold 226 (guide RNA with REV/RBE in the extended stem) and scaffold 174. We also produced these versions as bald (without a targeting moiety) to investigate whether these NLS constructs act as cell-penetrating peptides. Percent editing in tdT NPCs are shown for all the constructs in FIG. 89 (based on number of particles added) and in FIG. 90 (based on the volume of XDPs added). The $10^4$-$10^8$ titers of XDPs that were produced without a targeting moiety resulted in no editing in the mouse NPCs. EC50 for the different constructs were calculated and plotted as shown in FIG. 91. Fold change improvements in EC50 are depicted in FIGS. 92-94, with the fold change improvements in editing at 0.008 µl, 0.023 µl and 0.06 µl over the base control (V168-pXDP17+174), as shown in FIGS. 94-96. V238-pXDP255, V223-pXDP240, V239-pXDP256, V252-pXDP269 and V231-pXDP248 showed more than a 100-fold improvement over V168-pXDP17+174 as shown in FIG. 92. V238-pXDP255, V223-pXDP240 and V239-pXDP256 showed a 100-fold improvement over V168-pXDP17+226 as shown in FIG. 93. When we compared this library of NLS variants in the context of a guide RNA with RBE in the extended stem (scaffold 226) or without (scaffold 174), we observed a synergistic effect on XDP editing potency of some, but not all of the NLS variant constructs. This was particularly evident with V238-pXDP255 and V308-pXDP115 with more than a 10-fold improvement in editing potency with the addition of scaffold 226. V223-pXDP240, V228-pXDP245, V239-pXDP256, V252-pXDP269 and V231-pXDP248 showed 5 to 10-fold improvements in potency with the addition of scaffold 226, as shown in FIG. 94. We attribute this increase in potency to the REV/RBE-based nuclear export of guide RNA/XDP from the producer cell nucleus that leads to an increase in RNPs packaged into each XDP. These more potent XDPs can then release these CasX proteins that can then move more efficiently into the nucleus in the target cells, rendering them more potent than the base molecule (V168-pXDP17+174). Fold change improvements in editing at 0.023 µl XDP volume show that V238-pXDP255+226, V223-pXDP240+226, V239-pXDP256+226, V252-pXDP269+226 show more than a 15-fold improvement in potency over V168-pXDP17+174 as shown in FIG. 97.

The results show that, depending on the configuration, the editing potency of XDPs comprising RNPs can be vastly improved by engineering the NLS construct designs on the N- and C-terminal of the CasX protein. The most potent NLS constructs and designs have more rigid predicted secondary structures that may function to break secondary structures of the NLS from the CasX proteins. They may also function as a linker, contributing to more efficient RNP packaging in the XDPs. We also found an unpredicted synergistic effect on XDP potency by combining the novel NLS constructs with a nuclear export mechanism (REV/RBE) in the XDP producer cells. Furthermore, we have shown that the REV/RBE synergizes with these NLS elements to improve editing potencies with the addition of the REV/RBE element producing more than a 5-fold improvement across most of the NLS constructs. Table 79 also lists additional NLS configurations at the N- and C-terminal that holds promise in terms of improved potency in the V168+ Scaffold 226 format. These synergies were shown with CasX 491, and we anticipate similar results with other CasX variant proteins. In addition, these synergies were shown in the context of XDPs derived from HIV-based components utilized in the XDPs. We expect the beneficial effects of these NLS-CasX variants to translate their improved functionality with XDPs derived from any architectural variants of Alpharetroviral, Betaretroviral, Gammaretroviral, Deltaretroviral, Epsilonretroviral, Lentiviral and Spumaretroviral origin.

TABLE 78

Plasmid sequences for different Gag-CasX NLS constructs as well XDP structural plasmids

| XDP version | Plasmid number | Nucleic Acid Sequence SEQ ID NO | CasX With NLS (Amino Acid SEQ ID NO) |
|---|---|---|---|
| | pGP2 | 1003 | |
| | pXDP161 | (see Table 35 for pXDP161 sequence) | |
| 168 | pXDP17 | 1550 | |
| | pSG17 | 1551 | |
| 303 | pXDP112 | 1552 | 1611 |
| 304 | pXDP114 | 1553 | 1612 |
| 305 | pXDP116 | 1554 | 1613 |
| 306 | pXDP111 | 1555 | 1614 |
| 307 | pXDP113 | 1556 | 1615 |
| 308 | pXDP115 | 1557 | 1616 |
| 309 | pXDP219 | 1558 | 1617 |
| 310 | pXDP220 | 1559 | 1618 |
| 211 | pXDP223 | 1560 | 1619 |
| 212 | pXDP224 | 1561 | 1620 |
| 213 | pXDP225 | 1562 | 1621 |
| 214 | pXDP226 | 1563 | 1622 |
| 215 | pXDP227 | 1564 | 1623 |

TABLE 78-continued

Plasmid sequences for different Gag-CasX NLS constructs as well XDP structural plasmids

| XDP version | Plasmid number | Nucleic Acid Sequence SEQ ID NO | CasX With NLS (Amino Acid SEQ ID NO) |
|---|---|---|---|
| 216 | pXDP228 | 1565 | 1624 |
| 217 | pXDP229 | 1566 | 1625 |
| 218 | pXDP230 | 1567 | 1626 |
| 219 | pXDP231 | 1568 | 1627 |
| 220 | pXDP237 | 1569 | 1628 |
| 221 | pXDP238 | 1570 | 1629 |
| 222 | pXDP239 | 1571 | 1630 |
| 223 | pXDP240 | 1572 | 1631 |
| 224 | pXDP241 | 1573 | 1632 |
| 225 | pXDP242 | 1574 | 1633 |
| 226 | pXDP243 | 1575 | 1643 |
| 227 | pXDP244 | 1576 | 1635 |
| 228 | pXDP245 | 1577 | 1636 |
| 229 | pXDP246 | 1578 | 1637 |
| 230 | pXDP247 | 1579 | 1638 |
| 231 | pXDP248 | 1580 | 1639 |
| 232 | pXDP249 | 1580 | 1640 |
| 233 | pXDP250 | 1582 | 1641 |
| 234 | pXDP251 | 1583 | 1642 |
| 235 | pXDP252 | 1584 | 1643 |
| 236 | pXDP253 | 1585 | 1644 |
| 237 | pXDP254 | 1586 | 1645 |
| 238 | pXDP255 | 1587 | 1646 |
| 239 | pXDP256 | 1588 | 1647 |
| 246 | pXDP263 | 1589 | 1648 |
| 247 | pXDP264 | 1590 | 1649 |
| 248 | pXDP265 | 1591 | 1650 |
| 249 | pXDP266 | 1592 | 1651 |
| 250 | pXDP267 | 1593 | 1652 |
| 251 | pXDP268 | 1594 | 1653 |
| 252 | pXDP269 | 1595 | 1654 |
| 253 | pXDP270 | 1596 | 1655 |
| 254 | pXDP271 | 1597 | 1656 |
| 283 | pXDP322 | 1598 | 1657 |
| 284 | pXDP323 | 1599 | 1658 |
| 285 | pXDP324 | 1600 | 1659 |
| 286 | pXDP325 | 1601 | 1660 |
| 287 | pXDP326 | 1602 | 1661 |
| 288 | pXDP327 | 1603 | 1662 |
| 289 | pXDP328 | 1604 | 1663 |
| 290 | pXDP329 | 1605 | 1664 |
| 291 | pXDP333 | 1606 | 1665 |
| 292 | pXDP334 | 1607 | 1666 |
|  | pGP2 | 1003 |  |
|  | pSG005 | 1608 |  |
|  | pSG17 | 1609 |  |
|  | pXDP17 | 1610 |  |
|  | pXDP161 | (see Table 35 for pXDP161 sequence) |  |

TABLE 79

Plasmids of each XDP version and amino acid sequences of the N- and C-terminal and NLS of the encoded CasX 491 protein

| XDP version | Structural plasmid-1 | Structural plasmid-1 N-terminal NLS | SEQ ID NO | Structural plasmid-1 C-terminal NLS | SEQ ID NO | Structural plasmid-2 | Guide RNA Plasmid | GP plasmid |
|---|---|---|---|---|---|---|---|---|
| 303 | pXDP112 | PKKKRKVGGS PKKKRKVSRQ EIKRINKIRR RLVKDSNTKK AGKTGP | 1667 | TSPKKKRKVA LEYPYDVPDY A | 1723 | pXDP161 | pSG17/ pSG005 | pGP2 or any GP plasmid |
| 304 | pXDP114 | PKKKRKVGGS PKKKRKVGGS PKKKRKVGGS PKKKRKVSRQ EIKRINKIRR RLVKDSNTKK AGKTGP | 1668 | TSPKKKRKVA LEYPYDVPDY A | 1724 | pXDP161 | pSG17/ pSG005 | pGP2 or any GP plasmid |
| 305 | pXDP116 | PKKKRKVGGS PKKKRKVGGS PKKKRKVGGS PKKKRKVGGS PKKKRKVGGS PKKKRKVSRQ EIKRINKIRR RLVKDSNTKK AGKTGP | 1669 | TSPKKKRKVA LEYPYDVPDY A | 1725 | pXDP161 | pSG17/ pSG005 | pGP2 or any GP plasmid |
| 306 | pXDP111 | PAAKRVKLDG GSPAAKRVKL DSRQEIKRIN KIRRRLVKDS NTKKAGKTGP | 1670 | TSPKKKRKVA LEYPYDVPDY A | 1726 | pXDP161 | pSG17/ pSG005 | pGP2 or any GP plasmid |
| 307 | pXDP113 | PAAKRVKLDG GSPAAKRVKL DGGSPAAKRV KLDGGSPAAK RVKLDSRQEI KRINKIRRRL | 1671 | TSPKKKRKVA LEYPYDVPDY A | 1727 | pXDP161 | pSG17/ pSG005 | pGP2 or any GP plasmid |

TABLE 79-continued

Plasmids of each XDP version and amino acid sequences of the N- and C-terminal and NLS of the encoded CasX 491 protein

| XDP version | Structural plasmid-1 | Structural plasmid-1 N-terminal NLS | SEQ ID NO | Structural plasmid-1 C-terminal NLS | SEQ ID NO | Structural plasmid-2 | Guide RNA Plasmid | GP plasmid |
|---|---|---|---|---|---|---|---|---|
| | | VKDSNTKKAG KTGP | | | | | | |
| 308 | pXDP115 | PAAKRVKLDG GSPAAKRVKL DGGSPAAKRV KLDGGSPAAK RVKLDGGSPA AKRVKLDGGS PAAKRVKLDS RQEIKRINKI RRRLVKDSNT KKAGKTGP | 1672 | TSPKKKRKVA LEYPYDVPDY A | 1728 | pXDP161 | pSG17/ pSG005 | pGP2 or any GP plasmid |
| 309 | pXDP219 | KRPAATKKAG QAKKKKSRDI SRQEIKRINK IRRRLVKDSN TKKAGKTGP | 1673 | TLESKRPAAT KKAGQAKKKK APGEYPYDVP DYA | 1729 | pXDP161 | pSG17/ pSG005 | pGP2 or any GP plasmid |
| 310 | pXDP220 | KRPAATKKAG QAKKKKSRQE IKRINKIRRR LVKDSNTKKA GKTGP | 1674 | GSKRPAATKK AGQAKKKKYP YDVPDYA | 1730 | pXDP161 | pSG17/ pSG005 | pGP2 or any GP plasmid |
| 211 | pXDP223 | KRPAATKKAG QAKKKKGGSK RPAATKKAGQ AKKKKSRDIS RQEIKRINKI RRRLVKDSNT KKAGKTGP | 1675 | TLESKRPAAT KKAGQAKKKK GGSKRPAATK KAGQAKKKKA PGEYPYDVPD YA | 1731 | pXDP161 | pSG17/ pSG005 | pGP2 or any GP plasmid |
| 212 | pXDP224 | KRPAATKKAG QAKKKKGGSK RPAATKKAGQ AKKKKGGSKR PAATKKAGQA KKKKGGSKRP AATKKAGQAK KKKSRDISRQ EIKRINKIRR RLVKDSNTKK AGKTGP | 1676 | TLESKRPAAT KKAGQAKKKK GGSKRPAATK KAGQAKKKKG GSKRPAATKK AGQAKKKKGG SKRPAATKKA GQAKKKK | 1732 | pXDP161 | pSG17/ pSG005 | pGP2 or any GP plasmid |
| 213 | pXDP225 | KRPAATKKAG QAKKKKGGSK RPAATKKAGQ AKKKKGGSKR PAATKKAGQA KKKKGGSKRP AATKKAGQAK KKKGGSKRPA ATKKAGQAKK KKGGSKRPAA TKKAGQAKKK KSRDISRQEI KRINKIRRRL VKDSNTKKAG KTGP | 1677 | TLESKRPAAT KKAGQAKKKK GGSKRPAATK KAGQAKKKKG GSKRPAATKK AGQAKKKKGG SKRPAATKKA GQAKKKKGGS KRPAATKKAG QAKKKKGGSK RPAATKKAGQ AKKKK | 1733 | pXDP161 | pSG17/ pSG005 | pGP2 or any GP plasmid |
| 214 | pXDP226 | PKKKRKVGGS PKKKRKVGGS PKKKRKVGGS PKKKRKVSRD ISRQEIKRIN KIRRRLVKDS NTKKAGKTGP | 1678 | TLESPKKKRK VGGSPKKKRK VGGSPKKKRK VGGSPKKKRK V | 1734 | pXDP161 | pSG17/ pSG005 | pGP2 or any GP plasmid |
| 215 | pXDP227 | PKKKRKVGGS PKKKRKVGGS PKKKRKVGGS | 1679 | TLESPKKKRK VGGSPKKKRK VGGSPKKKRK | 1735 | pXDP161 | pSG17/ pSG005 | pGP2 or any GP plasmid |

TABLE 79-continued

Plasmids of each XDP version and amino acid sequences of the N- and C-terminal and NLS of the encoded CasX 491 protein

| XDP version | Structural plasmid-1 | Structural plasmid-1 N-terminal NLS | SEQ ID NO | Structural plasmid-1 C-terminal NLS | SEQ ID NO | Structural plasmid-2 | Guide RNA Plasmid | GP plasmid |
|---|---|---|---|---|---|---|---|---|
| | | PKKKRKVSRD ISRQEIKRIN KIRRRLVKDS NTKKAGKTGP | | VGGSPKKKRK V | | | | |
| 216 | pXDP228 | PAAKRVKLDG GSPAAKRVKL DGGSPAAKRV KLDGGSPAAK RVKLDSRDIS RQEIKRINKI RRRLVKDSNT KKAGKTGP | 1680 | TLESPAAKRV KLDGGSPAAK RVKLDGGSPA AKRVKLDGGS PAAKRVKLD | 1736 | pXDP161 | pSG17/ pSG005 | pGP2 or any GP plasmid |
| 217 | pXDP229 | PAAKRVKLDG GSPAAKRVKL DGGSPAAKRV KLDGGSPAAK RVKLDGGSPA AKRVKLDGGS PAAKRVKLDS RDISRQEIKR INKIRRRLVK DSNTKKAGKT GP | 1681 | TLESPAAKR VKLDGGSPA AKRVKLDG GSPAAKRVK LDGGSPAAK RVKLDGGSP AAKRVKLD GGSPAAKRV KLD | 1737 | pXDP161 | pSG17/ pSG005 | pGP2 or any GP plasmid |
| 218 | pXDP230 | KRPAATKKAG QAKKKKSRDI SRQEIKRINK IRRRLVKDSN TKKAGKTGP | 1682 | TLESKRPAA TKKAGQAK KKK | 1738 | pXDP161 | pSG17/ pSG005 | pGP2 or any GP plasmid |
| 219 | pXDP231 | KRPAATKKAG QAKKKKGGSK RPAATKKAGQ AKKKKSRDIS RQEIKRINKI RRRLVKDSNT KKAGKTGP | 1683 | TLESKRPAA TKKAGQAK KKKGGSKRP AATKKAGQ AKKKK | 1739 | pXDP161 | pSG17/ pSG005 | pGP2 or any GP plasmid |
| 220 | pXDP237 | PAAKRVKLDG GKRTADGSEF ESPKKKRKVG GSSRDISRQE IKRINKIRRR LVKDSNTKKA GKTGP | 1684 | TLEGGSPKK KRKV | 1740 | pXDP161 | pSG17/ pSG005 | pGP2 or any GP plasmid |
| 221 | pXDP238 | PAAKRVKLDG GKRTADGSEF ESPKKKRKVP PPPGSRDISR QEIKRINKIR RRLVKDSNTK KAGKTGP | 1685 | TLEGGSPKK KRKV | 1741 | pXDP161 | pSG17/ pSG005 | pGP2 or any GP plasmid |
| 222 | pXDP239 | PAAKRVKLDG GKRTADGSEF ESPKKKRKVG IHGVPAAPGS RDISRQEIKR INKIRRRLVK DSNTKKAGKT GP | 1686 | TLEGGSPKKK RKV | 1742 | pXDP161 | pSG17/ pSG005 | pGP2 or any GP plasmid |
| 223 | pXDP240 | PAAKRVKLDG GKRTADGSEF ESPKKKRKVG GGSGGGSPGS RDISRQEIKR INKIRRRLVK DSNTKKAGKT GP | 1687 | TLEGGSPKKK RKV | 1743 | pXDP161 | pSG17/ pSG005 | pGP2 or any GP plasmid |

TABLE 79-continued

Plasmids of each XDP version and amino acid sequences of the N- and C-terminal and NLS of the encoded CasX 491 protein

| XDP version | Structural plasmid-1 | Structural plasmid-1 N-terminal NLS | SEQ ID NO | Structural plasmid-1 C-terminal NLS | SEQ ID NO | Structural plasmid-2 | Guide RNA Plasmid | GP plasmid |
|---|---|---|---|---|---|---|---|---|
| 224 | pXDP241 | PAAKRVKLDGGKRTADGSEFESPKKKRKVPGGGSGGGSPGSRDISRQEIKRINKIRRRLVKDSNTKKAGKTGP | 1688 | TLEGGSPKKKRKV | 1744 | pXDP161 | pSG17/pSG005 | pGP2 or any GP plasmid |
| 225 | pXDP242 | PAAKRVKLDGGKRTADGSEFESPKKKRKVAEAAAKEAAAKEAAAKAPGSRDISRQEIKRINKIRRRLVKDSNTKKAGKTGP | 1689 | TLEGGSPKKKRKV | 1745 | pXDP161 | pSG17/pSG005 | pGP2 or any GP plasmid |
| 226 | pXDP243 | PAAKRVKLDGGKRTADGSEFESPKKKRKVPGSRDISRQEIKRINKIRRRLVKDSNTKKAGKTGP | 1690 | TLEGGSPKKKRKV | 1746 | pXDP161 | pSG17/pSG005 | pGP2 or any GP plasmid |
| 227 | pXDP244 | PAAKRVKLDGGSPKKKRKVGGSSRDISRQEIKRINKIRRRLVKDSNTKKAGKTGP | 1691 | TLEGGSPKKKRKV | 1747 | pXDP161 | pSG17/pSG005 | pGP2 or any GP plasmid |
| 228 | pXDP245 | PAAKRVKLDPPPPKKKRKVPGSRDISRQEIKRINKIRRRLVKDSNTKKAGKTGP | 1692 | TLEGGSPKKKRKV | 1748 | pXDP161 | pSG17/pSG005 | pGP2 or any GP plasmid |
| 229 | pXDP246 | PAAKRVKLDPGRSRDISRQEIKRINKIRRRLVKDSNTKKAGKTGP | 1693 | TLEGGSPKKKRKV | 1749 | pXDP161 | pSG17/pSG005 | pGP2 or any GP plasmid |
| 230 | pXDP247 | PKKKRKVSRDISRQEIKRINKIRRRLVKDSNTKKAGKTGP | 1694 | TLEVGPKRTADSQHSTPPKTKRKVEFEPKKKRKV | 1750 | pXDP161 | pSG17/pSG005 | pGP2 or any GP plasmid |
| 231 | pXDP248 | PKKKRKVSRDISRQEIKRINKIRRRLVKDSNTKKAGKTGP | 1695 | TLEVGGGSGGGSKRTADSQHSTPPKTKRKVEFEPKKKRKV | 1751 | pXDP161 | pSG17/pSG005 | pGP2 or any GP plasmid |
| 232 | pXDP249 | PKKKRKVSRDISRQEIKRINKIRRRLVKDSNTKKAGKTGP | 1696 | TLEVAEAAAKEAAAKEAAAKAKRTADSQHSTPPKTKRKVEFEPKKKRKV | 1752 | pXDP161 | pSG17/pSG005 | pGP2 or any GP plasmid |
| 233 | pXDP250 | PKKKRKVSRDISRQEIKRINKIRRRLVKDSNTKKAGKTGP | 1697 | TLEVGPPKKKRKVGGSKRTADSQHSTPPKTKRKVEFEPKKKRKV | 1753 | pXDP161 | pSG17/pSG005 | pGP2 or any GP plasmid |
| 234 | pXDP251 | PKKKRKVSRDISRQEIKRIN | 1698 | TLEVGPAEAAAKEAAAKEAA | 1754 | pXDP161 | pSG17/pSG005 | pGP2 or any GP |

TABLE 79-continued

Plasmids of each XDP version and amino acid sequences of the N- and C-terminal and NLS of the encoded CasX 491 protein

| XDP version | Structural plasmid-1 | Structural plasmid-1 N-terminal NLS | SEQ ID NO | Structural plasmid-1 C-terminal NLS | SEQ ID NO | Structural plasmid-2 | Guide RNA Plasmid | GP plasmid |
|---|---|---|---|---|---|---|---|---|
| | | KIRRRLVKDS NTKKAGKTGP | | AKAPAAKRVK LD | | | | plasmid |
| 235 | pXDP252 | PKKKRKVSRD ISRQEIKRIN KIRRRLVKDS NTKKAGKTGP | 1699 | TLEVGPGGGS GGGSGGGSPA AKRVKLD | 1755 | pXDP161 | pSG17/ pSG005 | pGP2 or any GP plasmid |
| 236 | pXDP253 | PKKKRKVSRD ISRQEIKRIN KIRRRLVKDS NTKKAGKTGP | 1700 | TLEVGPPKKK RKVPPPPAAK RVKLD | 1756 | pXDP161 | pSG17/ pSG005 | pGP2 or any GP plasmid |
| 237 | pXDP254 | PKKKRKVSRD ISRQEIKRIN KIRRRLVKDS NTKKAGKTGP | 1701 | TLEVGPPAAK RVKLD | 1757 | pXDP161 | pSG17/ pSG005 | pGP2 or any GP plasmid |
| 238 | pXDP255 | PAAKRVKLDG GKRTADGSEF ESPKKKRKVG GSSRDISRQE IKRINKIRRR LVKDSNTKKA GKTGP | 1702 | TLEVGPKRTA DSQHSTPPKT KRKVEFEPKK KRKV | 1758 | pXDP161 | pSG17/ pSG005 | pGP2 or any GP plasmid |
| 239 | pXDP256 | PAAKRVKLDG GKRTADGSEF ESPKKKRKVG GGSGGGSPGS RDISRQEIKR INKIRRRLVK DSNTKKAGKT GP | 1703 | TLEVGGGSGG GSKRTADSQH STPPKTKRKV EFEPKKKRKV | 1759 | pXDP161 | pSG17/ pSG005 | pGP2 or any GP plasmid |
| 246 | pXDP263 | PKKKRKVSRQ EIKRINKIRR RLVKDSNTKK AGKTGP | 1704 | GSKRPAATKK AGQAKKKK | 1760 | pXDP161 | pSG17/ pSG005 | pGP2 or any GP plasmid |
| 247 | pXDP264 | PKKKRKVGGS PKKKRKVGGS PKKKRKVGGS PKKKRKVSRQ EIKRINKIRR RLVKDSNTKK AGKTGP | 1705 | GSKRPAATKK AGQAKKKK | 1761 | pXDP161 | pSG17/ pSG005 | pGP2 or any GP plasmid |
| 248 | pXDP265 | PKKKRKVGGS PKKKRKVGGS PKKKRKVGGS PKKKRKVGGS PKKKRKVGGS PKKKRKVSRQ EIKRINKIRR RLVKDSNTKK AGKTGP | 1706 | GSKRPAATKK AGQAKKKK | 1762 | pXDP161 | pSG17/ pSG005 | pGP2 or any GP plasmid |
| 249 | pXDP266 | PAAKRVKLDS RQEIKRINKI RRRLVKDSNT KKAGKTGP | 1707 | GSPKKKRKV | 1763 | pXDP161 | pSG17/ pSG005 | pGP2 or any GP plasmid |
| 250 | pXDP267 | PAAKRVKLDS RQEIKRINKI RRRLVKDSNT KKAGKTGP | 1708 | GSKRPAATKK AGQAKKKK | 1764 | pXDP161 | pSG17/ pSG005 | pGP2 or any GP plasmid |
| 251 | pXDP268 | PAAKRVKLDG GSPAAKRVKL DSRQEIKRIN KIRRRLVKDS NTKKAGKTGP | 1709 | GSKRPAATKK AGQAKKKK | 1765 | pXDP161 | pSG17/ pSG005 | pGP2 or any GP plasmid |

TABLE 79-continued

Plasmids of each XDP version and amino acid sequences of the N- and C-terminal and NLS of the encoded CasX 491 protein

| XDP version | Structural plasmid-1 | Structural plasmid-1 N-terminal NLS | SEQ ID NO | Structural plasmid-1 C-terminal NLS | SEQ ID NO | Structural plasmid-2 | Guide RNA Plasmid | GP plasmid |
|---|---|---|---|---|---|---|---|---|
| 252 | pXDP269 | PAAKRVKLDG GSPAAKRVKL DGGSPAAKRV KLDGGSPAAK RVKLDSRQEI KRINKIRRRL VKDSNTKKAG KTGP | 1710 | GSKRPAATKK AGQAKKKK | 1766 | pXDP161 | pSG17/ pSG005 | pGP2 or any GP plasmid |
| 253 | pXDP270 | PAAKRVKLDG GSPAAKRVKL DGGSPAAKRV KLDGGSPAAK RVKLDGGSPA AKRVKLDGGS PAAKRVKLDS RQEIKRINKI RRRLVKDSNT KKAGKTGP | 1711 | GSKRPAATKK AGQAKKKK | 1767 | pXDP161 | pSG17/ pSG005 | pGP2 or any GP plasmid |
| 254 | pXDP271 | KRPAATKKAG QAKKKKSRQE IKRINKIRRR LVKDSNTKKA GKTGP | 1712 | GSPKKKRKV | 1768 | pXDP161 | pSG17/ pSG005 | pGP2 or any GP plasmid |
| 283 | pXDP322 | PAAKRVKLDS RQEIKRINKI RRRLVKDSNT KKAGKTGP | 1713 | GGGSGGGSKR TADSQHSTPP KTKRKVEFEP KKKRKV | 1769 | pXDP161 | pSG17/ pSG005 | pGP2 or any GP plasmid |
| 284 | pXDP323 | PAAKRVKLDS RQEIKRINKI RRRLVKDSNT KKAGKTGP | 1714 | GPPKKKRKVG GSKRTADSQH STPPKTKRKV EFEPKKKRKV | 1770 | pXDP161 | pSG17/ pSG005 | pGP2 or any GP plasmid |
| 285 | pXDP324 | PAAKRVKLDS RQEIKRINKI RRRLVKDSNT KKAGKTGP | 1715 | TGGGPGGGAA AGSGSPKKKR KVGSGS | 1771 | pXDP161 | pSG17/ pSG005 | pGP2 or any GP plasmid |
| 286 | pXDP325 | PAAKRVKLDS RQEIKRINKI RRRLVKDSNT KKAGKTGP | 1716 | GPKRTADSQH STPPKTKRKV EFEPKKKRKV | 1772 | pXDP161 | pSG17/ pSG005 | pGP2 or any GP plasmid |
| 287 | pXDP326 | PAAKRVKLDS RQEIKRINKI RRRLVKDSNT KKAGKTGP | 1717 | AEAAAKEAAA KEAAAKAKRT ADSQHSTPPK TKRKVEFEPK KKRKV | 1773 | pXDP161 | pSG17/ pSG005 | pGP2 or any GP plasmid |
| 288 | pXDP327 | PAAKRVKLDS RQEIKRINKI RRRLVKDSNT KKAGKTGP | 1718 | GPPKKKRKVP PPPAAKRVKL D | 1774 | pXDP161 | pSG17/ pSG005 | pGP2 or any GP plasmid |
| 289 | pXDP328 | PAAKRVKLDS RQEIKRINKI RRRLVKDSNT KKAGKTGP | 1719 | GSPAAKRVKL DGGSPAAKRV KLDGGSPAAK RVKLDGGSPA AKRVKLDGGS PAAKRVKLDG GSPAAKRVKL D | 1775 | pXDP161 | pSG17/ pSG005 | pGP2 or any GP plasmid |
| 290 | pXDP329 | PAAKRVKLDS RQEIKRINKI RRRLVKDSNT KKAGKTGP | 1720 | GSPAAKRVKL GGSPAAKRVK LGGSPKKKRK VGGSPKKKRK V | 1776 | pXDP161 | pSG17/ pSG005 | pGP2 or any GP plasmid |

TABLE 79-continued

Plasmids of each XDP version and amino acid sequences of the N- and C-terminal and NLS of the encoded CasX 491 protein

| XDP version | Structural plasmid-1 | Structural plasmid-1 N-terminal NLS | SEQ ID NO | Structural plasmid-1 C-terminal NLS | SEQ ID NO | Structural plasmid-2 | Guide RNA Plasmid | GP plasmid |
|---|---|---|---|---|---|---|---|---|
| 291 | pXDP333 | PKKKRKVGGS PKKKRKVGGS PKKKRKVGGS PKKKRKVGGS PKKKRKVGGS PKKKRKVSRQ EIKRINKIRR RLVKDSNTKK AGKTGP | 1721 | GSKRPAATKK AGQAKKKKGG SKRPAATKKA GQAKKKK | 1777 | pXDP161 | pSG17/ pSG005 | pGP2 or any GP plasmid |
| 292 | pXDP334 | PAAKRVKLDG GSPAAKRVKL DGGSPAAKRV KLDGGSPAAK RVKLDGGSPA AKRVKLDGGS PAAKRVKLDS RQEIKRINKI RRRLVKDSNT KKAGKTGP | 1722 | GSKRPAATKK AGQAKKKKGG SKRPAATKKA GQAKKKK | 1778 | pXDP161 | pSG17/ pSG005 | pGP2 or any GP plasmid |

Example 27: Evaluation of Nuclear Import and Export Systems—NLS Variants+/−RRE (XDP Version 206)

The purpose of these experiments was to demonstrate the effects of incorporating a variety of nuclear localization signals (NLS) to the CasX molecule in the MS2-based recruitment system of XDP version 206. Additionally, experiments were performed to determine if the inclusion of a portion of the HIV-1 rev response element (RRE) or modified portions of the RRE in the guide-sgRNA would increase the potency of these NLS-enhanced constructs in order to determine whether the nuclear export ability of the RRE-Rev system would counteract the effects of the NLSs in the producer cell.

Methods:

All plasmids containing CasX proteins had the CasX 491 variant protein. All XDPs were pseudotyped with 10% VSV-G (percentage of plasmid relative to the other plasmids utilized for the XDP construct). RNA fold structures were generated with RNAfold web server and Varna java-based software.

Structural Plasmid Cloning

In order to generate the structural plasmids used below, pXDP1 was digested using EcoRI to remove the Gag-pol sequence. Between one and three fragments containing CasX, HIV-1, or MS2 CP components were amplified and cloned as described in Example 7, above. The resultant plasmids were sequenced using Sanger sequencing to ensure correct assembly.

Guide Plasmid Cloning

The guide plasmids used in these experiments were pSG50, pSG72, pSG73, and pSG76 which were cloned from non-targeting plasmids pSG33, pSG67, pSG68, and pSG71. The mammalian expression backbone contained a cPPT, ampicillin resistance, and a colEI replication site and was amplified using primers with appropriate overlaps to accept the U6 promoter and guide RNA scaffold cassette. These fragments were amplified and cloned as described in Example 7, above. The resultant plasmids were sequenced using Sanger sequencing to ensure correct assembly (see Table 80).

TABLE 80

Guide scaffold sequences

| Plasmid number | Scaffold number | Target | Guide encoding sequence | SEQ ID NO |
|---|---|---|---|---|
| pSG0033 | 188 | 0.0 | ACTGGCGCTTTTATCTGATTACTTTGAGAGCCATCACCAGCG ACTATGTCGTAGTGGGTAAAGCTCACATGAGGATCACCCATG TGAGCATCAAAGCGAGACGTAATTACGTCTCG | 1135 |
| pSG50 | 188 | 12.7 | ACTGGCGCTTTTATCTGATTACTTTGAGAGCCATCACCAGCG ACTATGTCGTAGTGGGTAAAGCTCACATGAGGATCACCCATG TGAGCATCAAAGCGAGACGTAATTACGTCTCG | 1135 |
| pSG67 | 250 | 0.0 | ACTGGCGCTTTTATCTGATTACTTTGAGAGCCATCACCAGCG ACTATGTCGTAGTGGGTAAAGCTGCACTATGGGCGCAGCGTC AATGACGCTGACGGTACAGGCCACATGAGGATCACCCATGTG GTATAGTGCAGCATCAAAGCGAGACGTAATTACGTCTCG | 1200 |
| pSG68 | 251 | 0.0 | ACTGGCGCTTTTATCTGATTACTTTGAGAGCCATCACCAGCG ACTATGTCGTAGTGGGTAAAGCTGCACTATGGGCGCAGCTCA | 1201 |

TABLE 80-continued

Guide scaffold sequences

| Plasmid number | Scaffold number | Target | Guide encoding sequence | SEQ ID NO |
|---|---|---|---|---|
| | | | TGAGGATCACCCATGAGCTGACGGTACAGGCCACATGAGGAT CACCCATGTGGTATAGTGCAGCATCAAAGCGAGACGTAATTA CGTCTCG | |
| pSG69 | 252 | 0.0 | ACTGGCGCTTTTATCTGATTACTTTGAGAGCCATCACCAGCG ACTATGTCGTAGTGGGTAAAGCTGCACTATGGGCGCAGCGTC AATGACGCTGACGGTACAGGCCACATGGCAGTCGTAACGACG CGGGTGGTATAGTGCAGCATCAAAGCGAGACGTAATTACGTC TCG | 1227 |
| pSG71 | 254 | 0.0 | ACTGGCGCTTTTATCTGATTACTTTGAGAGCCATCACCAGCG ACTATGTCGTAGTGGGTAAAGCTGCACTATGGGCGCAGACAT GGCAGTCGTAACGACGCGGGTCTGACGGTACAGGCCACATGA GGATCACCCATGTGGTATAGTGCAGCATCAAAGCGAGACGTA ATTACGTCTCG | 1779 |
| pSG72 | 250 | 12.7 | ACTGGCGCTTTTATCTGATTACTTTGAGAGCCATCACCAGCG ACTATGTCGTAGTGGGTAAAGCTGCACTATGGGCGCAGCGTC AATGACGCTGACGGTACAGGCCACATGAGGATCACCCATGTG GTATAGTGCAGCATCAAAGCTGCATTCTAGTTGTGGTTT | 1202 |
| pSG73 | 251 | 12.7 | ACTGGCGCTTTTATCTGATTACTTTGAGAGCCATCACCAGCG ACTATGTCGTAGTGGGTAAAGCTGCACTATGGGCGCAGCTCA TGAGGATCACCCATGAGCTGACGGTACAGGCCACATGAGGAT CACCCATGTGGTATAGTGCAGCATCAAAGCTGCATTCTAGTT GTGGTTT | 1203 |
| pSG76 | 254 | 12.7 | ACTGGCGCTTTTATCTGATTACTTTGAGAGCCATCACCAGCG ACTATGTCGTAGTGGGTAAAGCTGCACTATGGGCGCAGACAT GGCAGTCGTAACGACGCGGGTCTGACGGTACAGGCCACATGA GGATCACCCATGTGGTATAGTGCAGCATCAAAGCTGCATTCT AGTTGTGGTTT | 1230 |

Cloning tdTomato Spacer 12.7 into pSG33, pSG67, pSG68, and 71

The targeting spacer sequence DNA for the tdTomato targeting spacer 12.7 was ordered as single-stranded DNA (ssDNA) oligos consisting of the targeting sequence (CTG-CATTCTAGTTGTGGTTT, SEQ ID NO: 1018) and the reverse complement of this sequence. These two oligos were annealed together and cloned into pSG33, pSG67, pSG68, and pSG71 plasmids done by Golden Gate assembly, as described in Example 7, above. The resultant plasmids were sequenced using Sanger sequencing to ensure correct ligation.

pGP2 Glycoprotein Plasmid Cloning

Sequences encoding the VSV-G glycoprotein and the CMV promoter were amplified from pMD2.G (UC Berkeley) and cloned as described in Example 7, above. The backbone was taken from a kanamycin resistant plasmid and amplified and cloned using the same methods. Assembled products were transformed into chemically-competent Turbo Competent E. coli bacterial cells, plated on LB-Agar plates containing kanamycin and incubated at 37° C. The resultant plasmids were sequenced using Sanger sequencing to ensure correct assembly (see Table 83).

Cell Culture and Transfection

HEK293T Lenti-X cell culture was performed as described in Example 7, above. For transfection, the XDP structural plasmids (also encoding the CasX-NLS variants of Table 82) of Table 81 were used in amounts ranging from 13 to 80.0 pg. Each transfection also received 13 µg of sgRNA plasmid and 0.25 µg of pGP2. Polyethylenimine was then added as described in Example 7, above.

TABLE 81

Plasmid ratios of V206

| XDP version 206 plasmids | Structural plasmid ratios |
|---|---|
| Gag-(-1)-PR* | 10% |
| Gag-MS2* | 45% |
| CasX* | 45% |

*transcript contains RRE and produces REV

TABLE 82

CasX-NLS plasmids for each tested NLS

| Plasmid number | CasX + NLS |
|---|---|
| pXDP343 | CasX 491 NLS 115 |
| pXDP344 | CasX 491 NLS 240 |
| pXDP345 | CasX 491 NLS 245 |
| pXDP346 | CasX 491 NLS 247 |
| pXDP347 | CasX 491 NLS 248 |
| pXDP348 | CasX 491 NLS 251 |
| pXDP349 | CasX 491 NLS 252 |
| pXDP350 | CasX 491 NLS 255 |
| pXDP351 | CasX 491 NLS 256 |
| pXDP352 | CasX 491 NLS 269 |

TABLE 83

Architecture and Glycoprotein sequences

| Plasmid number | Architecture | DNA Sequence |
|---|---|---|
| pGP2 | VSV-G | 1003 |
| pXDP161* | Gag-(-1)-PR | (see Table 35 for pXDP161 sequence) |
| pXDP164* | Gag-(-1)-MS2 CP | 1780 |
| pXDP166* | SV40NLS-CasX491-SV40 NLS | (see Table 35 for pXDP166 sequence) |
| pXDP343* | CasX491 NLS 115 | 1781 |
| pXDP344* | CasX491 NLS 240 | 1782 |
| pXDP345* | CasX491 NLS 245 | 1783 |
| pXDP346* | CasX491 NLS 247 | 1784 |
| pXDP347* | CasX491 NLS 248 | 1785 |
| pXDP348* | CasX491 NLS 251 | 1786 |
| pXDP349* | CasX491 NLS 252 | 1787 |
| pXDP350* | CasX491 NLS 255 | 1788 |
| pXDP351* | CasX491 NLS 256 | 1789 |
| pXDP352* | CasX491 NLS 269 | 1790 |

*backbone of plasmid expresses rev

Collection and Concentration

XDPs were collected and concentrated as described in Example 8, above.

Resuspension and Transduction tdTomato neural progenitor cells were resuspended and transduced as described in Example 7, above, and tdTomato fluorescence was measured using flow cytometry.

Results:

The base V206 contains a CasX protein with flanking SV40 NLSs on the N- and C-terminal domains to increase potency by localizing CasX to the nucleus in the target cell. In these assays we tested 9 alternate NLS sequences; NLS 115, 240, 247, 248, 251, 252, 255, 256, and 269. Six of the nine tested NLSs performed better than the base SV40 NLS, with the top three variants being NLS 240, 248, and 251. These performed 11-, 10-, and 14-fold better by inverse EC50 by volume than the base V206 SV40 NLS (Table 84).

TABLE 84

Potency of NLS variants

| Construct | Inverse EC50 by volume | Potency relative to V206 |
|---|---|---|
| V206 NLS 115 | 1.08 | 0.69 |
| V206 NLS 240 | 17.45 | 11.19 |
| V206 NLS 247 | 6.25 | 4.01 |
| V206 NLS 248 | 16.50 | 10.59 |
| V206 NLS 251 | 22.38 | 14.35 |
| V206 NLS 252 | 9.75 | 6.25 |
| V206 NLS 255 | 0.54 | 0.35 |
| V206 NLS 256 | 0.13 | 0.08 |
| V206 NLS 269 | 2.03 | 1.30 |
| V206 | 1.56 | 1.00 |

Two NLS variants, NLS 240 and 255, were selected to be tested with guide scaffolds that were engineered to contain a portion of the RRE, termed "RBE". Scaffolds 250, 251, and 254 (FIGS. 45, 46, 55, respectively) each contain one or two RBEs and one or two MS2 hairpins (see Table 86). These scaffolds were compared to scaffold 188 (FIG. 32) which contains one MS2 hairpin and no RBEs. The results of the assay show that scaffolds containing an RBE performed 2 to 6-fold better with NLS 240 and 10 to 23-fold better with NLS 255 (see Table 85). In both NLS 240 and NLS 255, scaffold 251 performed best with a 6-fold increase with NLS 240 and a 23-fold increase with NLS 255. There was a slight decrease in potency with RBE containing scaffolds in base V206 with the least potent scaffold, scaffold 254, being 40% as potent as scaffold 188 in the base V206 XDP construct.

TABLE 85

Potency of RRE scaffolds

| Variant | Inverse EC50 by volume | Fold increase in potency over NLS with scaffold 188 |
|---|---|---|
| XDP version 206 NLS 240 Scaff 250 | 46.45 | 2.66 |
| XDP version 206 NLS 240 Scaff 251 | 98.33 | 5.64 |
| XDP version 206 NLS 240 Scaff 254 | 41.53 | 2.38 |
| XDP version 206 NLS 255 Scaff 250 | 7.42 | 13.66 |
| XDP version 206 NLS 255 Scaff 251 | 12.69 | 23.38 |
| XDP version 206 NLS 255 Scaff 254 | 5.86 | 10.80 |
| XDP version 206 Scaff 250 | 1.45 | 0.93 |
| XDP version 206 Scaff 251 | 1.10 | 0.71 |
| XDP version 206 Scaff 254 | 0.64 | 0.41 |
| XDP version 206 NLS 240 | 17.45 | 1 |
| XDP version 206 NLS 255 | 0.545 | 1 |
| XDP version 206 | 1.564 | 1 |

TABLE 86

Features of MS2 and RBE containing scaffolds

| Scaffold | Variant | Left loop | Right loop | Parent scaffold | Number of RBE |
|---|---|---|---|---|---|
| 188 | 174 with MS2 hairpin | N/A | N/A | 174 | 0 |
| 250 | 226 with one MS2 HP | normal | MS2 HP | 226 | 1 |
| 251 | 226 with dual MS2 HP | MS2 HP | MS2 HP | 226 | 1 |
| 254 | 226 RBE + MS2 | RBE | MS2 | 226 | 2 |

These data show that NLS variants can be designed that can increase the potency of the XDP, and that potency can be further enhanced with the use of guide scaffolds with incorporated RBE. These findings support additional efforts to expand the types and combinations of NLS variants and HIV-1 interacting scaffolds in order to further increase the potency of XDP.

Example 28: XDP Based on ALV Variants

The purpose of the experiments was to demonstrate the feasibility of creating potent XDP capable of editing target cells based on Gag-pro and Gag polyproteins derived from different Alpharetroviruses.

Editing efficiency and specificity can be altered and enhanced with the method of CasX delivery that is employed. A wide variety of viral vector families, including those of retroviral origin, can be engineered for the transient delivery of CasX RNPs. Previously, we have shown that CasX can be delivered to the target cell by directly fusing it to the Gag polyprotein, Gag-Pro polyprotein, or to different permutations of the protein domains that constitute the Gag-polyprotein of any retroviral origin (Alpharetroviruses, Betaretroviruses, Gammaretroviruses, Deltaretroviruses, Epsilonretroviruses, Lentiviruses and Spumaretroviruses). Here, we have focused on Gag-pro and Gag polyproteins derived from different Alpharetroviruses and explored their ability to deliver CasX complexed as RNPs to target cells.

Methods:

All plasmids encoding CasX proteins used the CasX 491 variant protein.

Structural Plasmid Cloning

Sequences for Gag-pro-CasX constructs where the Gag-pro sequences are derived from different Alpharetroviruses are provided in Table 87. The designed constructs were synthesized as transgenes and purchased from Twist Biosciences. In order to generate the structural plasmids used to generate the XDP, pXDP1 was digested using EcoRI to remove the Gag-pol sequence. Between one and three fragments containing CasX, ALV and HIV-1 components were amplified and cloned as described in Example 7, above. The resultant plasmids were sequenced using Sanger sequencing to ensure correct assembly.

Guide Plasmid Cloning

The guide plasmids used in these experiments was pSG005. pSG005 has the scaffold 174 along with the spacer 12.7 targeting tdTomato. To clone the targeting pSG005 we cloned the spacer 12.7 using the following protocol. The targeting spacer sequence DNA for the tdTomato targeting spacer 12.7 was ordered as single-stranded DNA (ssDNA) oligos (Integrated DNA Technologies) consisting of the targeting sequence (CTGCATTCTAGTTGTGGTTT, SEQ ID NO: 1018) and the reverse complement of this sequence. These two oligos were annealed together and cloned into a pSG plasmid with an alternate scaffold by Golden Gate assembly as described in Example 7, above. The resultant plasmids were sequenced using Sanger sequencing to ensure correct ligation pGP2 Glycoprotein Plasmid Cloning Sequences encoding the VSV-G glycoprotein and the CMV promoter were amplified from pMD2.G (UC Berkeley) and cloned as described in Example 7, above. The backbone was taken from a kanamycin resistant plasmid and amplified and cloned using the same methods. Assembled products were transformed into chemically-competent Turbo Competent *E. coli* bacterial cells, plated on LB-Agar plates containing kanamycin and incubated at 37° C. The resultant plasmids were sequenced using Sanger sequencing to ensure correct assembly (see Table 87).

TABLE 87

Encoding sequences for ALV variant constructs and other plasmids that constitute XDPs

| Plasmid number | XDP version | SEQ ID NO of DNA Encoding Sequence |
| --- | --- | --- |
| pGP2 | | 1793 |
| pXDP161 | 168 | (see Table 35 for pXDP161 sequence) |
| pXDP17 | 168 | 1794 |
| pSG17 | | 1795 |

TABLE 87-continued

Encoding sequences for ALV variant constructs and other plasmids that constitute XDPs

| Plasmid number | XDP version | SEQ ID NO of DNA Encoding Sequence |
| --- | --- | --- |
| pSG005 | | 1796 |
| pXDP40 | 44 | 1797 |
| pXDP144 | 44 | 1798 |
| pXDP145 | 102 | 1799 |
| pXDP150 | 138 | 1800 |
| pXDP151 | 139 | 1801 |
| pXDP152 | 140 | 1802 |
| pXDP153 | 141 | 1803 |
| pXDP154 | 142 | 1804 |
| pXDP155 | 143 | 1805 |
| pXDP156 | 144 | 1806 |
| pXDP157 | 145 | 1807 |
| pXDP158 | 146 | 1808 |
| pXDP159 | 147 | 1809 |
| pXDP190 | 187 | 1810 |
| pXDP191 | 188 | 1811 |
| pXDP192 | 189 | 1812 |
| pXDP193 | 190 | 1813 |
| pXDP194 | 191 | 1814 |
| pXDP195 | 192 | 1815 |
| pXDP196 | 193 | 1816 |
| pXDP197 | 194 | 1817 |
| pXDP198 | 195 | 1818 |
| pXDP199 | 196 | 1819 |
| pXDP200 | 197 | 1820 |

Cell Culture and Transfection

HEK293T Lenti-X cell culture was performed as described in Example 7, above. XDP Version 44, 138, 139, 140, 141, 142, 143, 144, 145, 146, 147 is composed of structural plasmid pXDP144, pXDP145, pXDP150, pXDP151, pXDP152, pXDP153, pXDP154, pXDP155, pXDP156, pXDP157, pXDP158, pXDP159, respectively. Version 168 is composed of structural plasmids pXDP17 and pXDP161. For transfection, the XDP structural plasmids (pXDP144, pXDP145, pXDP150, pXDP151, pXDP152, pXDP153, pXDP154, pXDP155, pXDP156, pXDP157, pXDP158, pXDP159, pXDP17, pXDP161) were used in amounts ranging from 13 to 80.0 µg. Each transfection also received 13 µg of either pSG005 or pSG17 and 2.5 µg of pGP2. Polyethylenimine (PEI Max from Polyplus) was then added as described in Example 7.

Collection and Concentration

XDPs were collected and concentrated as described in Example 8, above.

Resuspension and Transduction tdTomato neural progenitor were resuspended and transduced as described in Example 7, above. The assays were run 2-3 times for each sample with similar results.

Results:

Percent editing of the dtTomato target sequence in tdT NPCs are shown for all the constructs in FIG. 98 across the dilution curve for the volume of XDPs added, with the previously shown constructs V44, V102 and V168 serving as controls. FIG. 99 shows percent editing when 50 µl of concentrated XDPs are used to treat tdTomato NPCs. These results show that XDP derived from all of the different strains of Alpharetroviruses that were utilized in this experiment exhibited editing ranging from 10 to 80% when used to deliver CasX RNPs to mouse NPCs. These data support that the Gag-protease or Gag polyproteins derived from different strains of Alpharetroviruses are amenable to being engineered as XDP platforms for delivery of CasX RNPs. This opens up the possibility of exploring these different Alpharetroviral strains in other architectural or version formats. In particular, versions 187, 188, 189, 190, 191, 192, 193, 194, 195, 196, 197 could be produced by transfecting structural plasmids pXDP190, pXDP191, pXDP192, pXDP193, pXDP194, pXDP195, pXDP196, pXDP197, pXDP198, pXDP199, pXDP200, along with pSG005 or pSG17 and pGP2, as listed in Table 87. These different versions derived from different Alpharetroviral strains can be explored in different cell and tissue types, where they could offer unique advantages over XDP versions based on HIV viral strains. In addition, these different Alpharetroviral strains can be explored with different targeting moieties wherein some of these strains might show enhanced tropism capabilities.

Example 29: Enhancing Export Mechanisms—NLS Variants+/−RRE Evaluated In Vivo

The purpose of these experiments was to evaluate the effects on in vivo editing potency of the addition of NLS sequences to the N- and/or C-terminal end of CasX and RRE into guide RNA sequences that are incorporated into XDP constructs.

Methods

All plasmids containing CasX proteins encoded the CasX 491 variant protein. All XDPs were pseudotyped with 10% VSV-G (percentage of plasmid relative to the other plasmids utilized for the XDP construct). RNA fold structures were generated with RNAfold web server and Varna java-based software.

Structural Plasmid Cloning

In order to generate the structural plasmids used below, pXDP1 (obtained from UC Berkeley) was digested using EcoRI to remove the Gag-pol sequence. Between one and three fragments containing the CasX 491 variant protein with the different NLS constructs as shown in Table 79 and HIV-1 components were amplified and cloned as described in Example 7, above. The resultant plasmids were sequenced using Sanger sequencing to ensure correct assembly. The plasmids with the sequences and corresponding version numbers are listed in Table 88.

Guide Plasmid Cloning

The guide plasmids used in these experiments were either pSG005 or pSG17. pSG17 has both the spacer 12.7 targeting tdTomato as well as the scaffold 226 that has the RRE/RBE element that has been described in previous examples. pSG005 has the scaffold 174 along with the spacer 12.7 targeting tdTomato. To clone the targeting pSG005 and pSG17 we cloned the spacer 12.7 using the following protocol. The targeting spacer sequence DNA for the tdTomato targeting spacer 12.7 was ordered as single-stranded DNA (ssDNA) oligos (Integrated DNA Technologies) consisting of the targeting sequence (CTGCATTCTAGTTGTGGTTT, SEQ ID NO: 1018) and the reverse complement of this sequence. These two oligos were annealed together and cloned into a pSG plasmid with an alternate scaffold by Golden Gate assembly as described in Example 7, above. The resultant plasmids were sequenced using Sanger sequencing to ensure correct ligation.

pGP2 Glycoprotein Plasmid Cloning

Sequences encoding the VSV-G glycoprotein and the CMV promoter were amplified from pMD2.G (UC Berkeley) and cloned as described in Example 7, above. The backbone was taken from a kanamycin resistant plasmid and amplified and cloned using the same methods. Assembled products were transformed into chemically-competent Turbo Competent E. coli bacterial cells, plated on LB-Agar plates containing kanamycin and incubated at 37° C. The resultant plasmids were sequenced using Sanger sequencing to ensure correct assembly.

Cell Culture and Transfection

HEK293T Lenti-X cell culture was performed as described in Example 7, above. Structural plasmid 1 for XDP Version 1 (pXDP17), Version 310 (pXDP240) and Version 311 (pXDP255) all encode for CasX 491 with different NLS. Structural plasmid 2 for all the versions is pXDP001. The guide plasmids used in these experiments were either pSG005 or pSG17. pSG17 has both the spacer 12.7 targeting TdTomato as well as the scaffold 226. The plasmid encoding the glycoprotein was pGP2. For transfection, the XDP structural plasmids listed above and in Table 88 were used in amounts ranging from 13 to 80.0 μg. Each transfection also received 13 μg of pSG17 (gRNA) and 0.25 μg of pGP2. Polyethylenimine (PEI Max from Polyplus) was then added as described in Example 7.

TABLE 88

Plasmid sequences for different Gag-CasX NLS constructs as well XDP structural plasmids

| XDP version | Plasmid number | Nucleic Acid Sequence |
|---|---|---|
|  | pGP2 | (see Table 16 for sequence) |
|  | pXDP161 | (see Table 35 for sequence) |
|  | pSG17 | (see Table 78 sequence) |
|  | pSG005 | (see Table 87 for sequence) |
|  | pXDP1 | (see Table 20 for sequence) |
| 168 | pXDP17 | (see Table 78 for sequence) |
| 310 | pXDP240 | (see Table 78 for sequence) |
| 311 | pXDP255 | (see Table 78 for sequence) |

Collection and Concentration

XDPs were collected and concentrated as described in Example 7, above.

Resuspension and Transduction

The XDP filtered supernatant was divided evenly into an appropriate number of centrifuge tubes or bottles and ⅕th of the supernatant volume of Sucrose Buffer (50 mM Tris-HCL, 100 mM NaCl, 10% Sucrose, pH 7.4) was underlaid using serological pipettes. The samples were centrifuged at 10,000×g, 4° C., in a swinging-bucket rotor for 4 hours with no brake. The supernatant was carefully removed and the pellet briefly dried by inverting the centrifuge vessels. Pellets were resuspended in Storage Buffer (PBS+113 mM NaCl, 15% trehalose dihydrate, pH8) by gentle trituration and vortexing.

Stereotaxic infusion of Cas9 RNPs in mice and processing of brain tissues. Adult tdTOM/tdTOM mice were group housed and experiments were conducted in conformance with approved IACUC protocols. Prior to infection, mice were anesthetized with isoflurane. The anesthetized mouse was aligned on an Angle two stereotactic frame (Leica, Germany) and craniotomies were performed by stereotaxic surgery to target the Substantia Nigra (SN). Mice received a unilateral XDP injection with 8.15×10⁸ particles of one of the three XDP test articles. Mice were sacrificed 3 weeks post injection, brains harvested and fixed with 4% PFA and cryosectioned (10 um thick sections) and mounted on microscope slides. TH+ dopaminergic neurons in the SN were labeled with TH antibody and cell nuclei labeled with DAPI.

Results:

Here we measured in vivo gene-editing activity of three XDPs delivered by stereotaxic injection into the mouse brain. We programmed the CasX RNPs packaged in the XDPs to edit a STOP cassette between a promoter and TdTomato Red Fluorescent Protein gene that when deleted causes expression of tdTomato protein only in edited cells. Therefore the presence of tdTomato+ signal visually reports gene editing. TdTomato protein can be visualized using standard fluorescent microscopes without additional signal amplification.

The XDPs differed in the composition and arrangement of the nuclear localization signals (NLS) on the CasX protein. We delivered $8.15 \times 10^8$ XDPs of each preparation as determined by the Nanosight physical titering method to the Substantia Nigra (SN). Tyrosine Hydroxylase (TH) antibody staining marks SN dopaminergic neurons. XDP version 1 showed sparse editing activity in astrocytes surrounding the TH+ neurons. We observed significantly more editing activity (approx. 10 to 100-fold), as determined by the amount of tdTomato+ cells, with XDP versions 310 (pXDP240) and 311 (pXDP255) compared to version 1 (FIG. 108). Further, there was a dose-dependent increase in editing observed when different doses of XDP version 311 were administered (FIG. 109).

These data show how engineering the composition and organization of the nuclear localization sequences appended to the N- or C-terminus of CasX protein leads to more potent XDPs in vivo. More potent XDPs are important for lowering the required therapeutic XDP dose to achieve therapeutically-relevant levels of cell editing, increasing patient safety, and will require smaller scale manufacturing; factors important for the use of XDPs for gene editing applications in vivo.

Example 30: Improving MS2 Hairpin Binding Affinity Enhances XDP Editing Potency In previous examples, editing potency of XDPs was improved using a recruitment strategy whereby the gRNA of the CasX:gRNA RNP complex contains a functionalized RNA extended stem with an MS2 hairpin having high affinity for a Gag-MS2 RNA-binding protein (RBP). Binding of the RNA hairpin to the MS2 RBP enables recruitment of the CasX RNP cargo to the XDP particle. Upon delivery of the XDP to the target cell for editing, this RNA hairpin-MS2 RBP is expected to dissociate, allowing CasX to translocate to the nucleus. Thus, increasing the stability of the MS2 protein-RNA complex supports XDP formation, which may be achieved by changing the MS2 RNA-binding protein or RNA hairpin sequences to increase the binding affinity between these components.

To explore this principle further, gRNAs incorporating RNA hairpin variants with varying affinities for the MS2 RBP were evaluated using a high-throughput, in vitro biochemical assay to assess equilibrium binding and dissociation kinetics (Buenrostro et al., Quantitative analysis of RNA-protein interactions on a massively parallel array reveals biophysical and evolutionary landscapes. Nat Biotechnol. 32(6):562 (2014)). gRNA hairpin variants and their associated $K_D$ (dissociation constant) values are listed in Table 89; sequences of the guide plasmids encoding the different MS2 RNA hairpin variants are provided in Table 90 and the sequences of the MS2 hairpins are provided in Table 91.

Experiments were conducted to investigate whether gRNAs containing MS2 hairpin variants with improved binding affinity would enhance XDP formation or editing potency. Specifically, multiple MS2 hairpin variants with varying equilibrium binding affinities were assessed for their effects on XDP potency and titer. Several non-binding variants were also included in these experiments.

TABLE 89 gRNA scaffolds containing MS2 hairpin variants with varying affinities and their dissociation constant values ($K_D$). Specific positions for the indicated nucleotide mutations refer to the positions of the base MS2 hairpin (scaffold 188) depicted in FIG. 110

| Scaffold No. | Positions of indicated nucleotide changes within MS2 hairpin (scaffold 188) | $K_D$ (nM) | $K_{OFF}$ (1/s) | $-\Delta \log(K_{OFF})/-\Delta\Delta G$ |
|---|---|---|---|---|
| High affinity MS2 hairpin variants | | | | |
| 188 | | 2.558 | 0.001 | |
| 251 | | 2.558 | | |
| 296 | −13C, 1G | 1.881 | 0.001 | 0.510 |
| 297 | −15G, 3C | 2.112 | 0.001 | 0.062 |
| 298 | −15G, −13C, 1G, 3C | | | |
| 299 | −15G, −13C, −8C, −3G, 1G, 3C | | | |
| 300 | −8C, −3G | 2.686 | 0.002 | >1 |
| Medium-high affinity MS2 hairpin variants | | | | |
| 304 | −13U | 9.346 | 0.002 | 0.286 |
| 307 | −11U, −1A | 9.226 | 0.003 | 0.579 |
| 313 | −6C | 9.274 | 0.002 | 0.400 |
| Medium affinity MS2 hairpin variants | | | | |
| 301 | −8U, −3A | 34.084 | 0.007 | 0.654 |
| 303 | −15C, −13U | | 0.002 | 0.089 |
| 305 | −13C | 17.634 | 0.002 | 0.163 |
| 306 | −1U | | 0.015 | 0.854 |
| 310 | −5U | 36.912 | 0.016 | 0.910 |
| 314 | −14G, 3G | | 0.002 | 0.120 |
| Medium-low affinity MS2 hairpin variants | | | | |
| 308 | −11U, −1G | 77.562 | 0.018 | 0.754 |

TABLE 89-continued gRNA scaffolds containing MS2 hairpin variants with varying affinities and their dissociation constant values ($K_D$). Specific positions for the indicated nucleotide mutations refer to the positions of the base MS2 hairpin (scaffold 188) depicted in FIG. 110

| Scaffold No. | Positions of indicated nucleotide changes within MS2 hairpin (scaffold 188) | $K_D$ (nM) | $K_{OFF}$ (1/s) | $-\Delta\log(K_{OFF})/-\Delta\Delta G$ |
|---|---|---|---|---|
| Low affinity IV S2 hairpin variants ||||| 
| 309 | −11U, −1U | 453.563 | N/A | N/A |
| 311 | −5A | 415.477 | N/A | N/A |
| 302 | −8A, −3G | 1489.244 | N/A | N/A |
| No affinity MS2 hairpin variants ||||| 
| 312 | −5G | 12506.440 | N/A | N/A |
| 315 | −10G | 18018.92728 | N/A | N/A |

TABLE 90

Sequences of XDP plasmids

| Plasmid number | Description | DNA Sequence |
|---|---|---|
| pXDP161 | Gag-(-1)-PR | 1821 |
| pXDP164 | Gag-MS2 | 1822 |
| pXDP353 | Gag-MS2(N55K) | 1823 |
| pXDP344 | CasX 491 NLS 240 | 1824 |
| pSG50 | Scaffold 188 | ACTGGCGCTTTTATCTGATTACTTTGAGAGCCATCACCAGCGACTATGTCGTAGTGGGTAAAGCTCACATGAGGATCACCCATGTGAGCATCAAAGCTGCATTCTAGTTGTGGTTT (SEQ ID NO: 1825) |
| pSG73 | Scaffold 251 | ACTGGCGCTTTTATCTGATTACTTTGAGAGCCATCACCAGCGACTATGTCGTAGTGGGTAAAGCTGCACTATGGGCGCAGCTCATGAGGATCACCCATGAGCTGACGGTACAGGCCACATGAGGATCACCCATGTGGTATAGTGCAGCATCAAAGCTGCATTCTAGTTGTGGTTT (SEQ ID NO: 1203) |
| pSG170 | Scaffold 296 | ACTGGCGCTTTTATCTGATTACTTTGAGAGCCATCACCAGCGACTATGTCGTAGTGGGTAAAGCTCACCTGAGGATCACCCAGGTGAGCATCAAAGCTGCATTCTAGTTGTGGTTTTTTTTT (SEQ ID NO: 1826) |
| pSG171 | Scaffold 297 | ACTGGCGCTTTTATCTGATTACTTTGAGAGCCATCACCAGCGACTATGTCGTAGTGGGTAAAGCTCGCATGAGGATCACCCATGCGAGCATCAAAGCTGCATTCTAGTTGTGGTTTTTTTTT (SEQ ID NO: 1827) |
| pSG172 | Scaffold 298 | ACTGGCGCTTTTATCTGATTACTTTGAGAGCCATCACCAGCGACTATGTCGTAGTGGGTAAAGCTCGCCTGAGGATCACCCAGGCGAGCATCAAAGCTGCATTCTAGTTGTGGTTTTTTTTT (SEQ ID NO: 1828) |
| pSG173 | Scaffold 299 | ACTGGCGCTTTTATCTGATTACTTTGAGAGCCATCACCAGCGACTATGTCGTAGTGGGTAAAGCTCGCCTGAGCATCAGCCAGGCGAGCATCAAAGCTGCATTCTAGTTGTGGTTTTTTTTT (SEQ ID NO: 1829) |
| pSG174 | Scaffold 300 | ACTGGCGCTTTTATCTGATTACTTTGAGAGCCATCACCAGCGACTATGTCGTAGTGGGTAAAGCTCACATGAGCATCAGCCATGTGAGCATCAAAGCTGCATTCTAGTTGTGGTTTTTTTTT (SEQ ID NO: 1830) |
| pSG175 | Scaffold 301 | ACTGGCGCTTTTATCTGATTACTTTGAGAGCCATCACCAGCGACTATGTCGTAGTGGGTAAAGCTCACATGAGTATCAACCATGTGAGCATCAAAGCTGCATTCTAGTTGTGGTTTTTTTTT (SEQ ID NO: 1831) |
| pSG176 | Scaffold 302 | ACTGGCGCTTTTATCTGATTACTTTGAGAGCCATCACCAGCGACTATGTCGTAGTGGGTAAAGCTCACATGAGAATCAGCCATGTGAGCATCAAAGCTGCATTCTAGTTGTGGTTTTTTTTT (SEQ ID NO: 1832) |
| pSG177 | Scaffold 303 | ACTGGCGCTTTTATCTGATTACTTTGAGAGCCATCACCAGCGACTATGTCGTAGTGGGTAAAGCTCCCTTGAGGATCACCCATGTGAGCATCAAAGCTGCATTCTAGTTGTGGTTTTTTTTT (SEQ ID NO: 1833) |

TABLE 90-continued

Sequences of XDP plasmids

| Plasmid number | Description | DNA Sequence |
|---|---|---|
| pSG178 | Scaffold 304 | ACTGGCGCTTTTATCTGATTACTTTGAGAGCCATCACCAGCGACTATGTCGTAGTGGGTAAAGCTCACTTGAGGATCACCCATGTGAGCATCAAAGCTGCATTCTAGTTGTGGTTTTTTTTT (SEQ ID NO: 1834) |
| pSG179 | Scaffold 305 | ACTGGCGCTTTTATCTGATTACTTTGAGAGCCATCACCAGCGACTATGTCGTAGTGGGTAAAGCTCACCTGAGGATCACCCATGTGAGCATCAAAGCTGCATTCTAGTTGTGGTTTTTTTTT (SEQ ID NO: 1835) |
| pSG180 | Scaffold 306 | ACTGGCGCTTTTATCTGATTACTTTGAGAGCCATCACCAGCGACTATGTCGTAGTGGGTAAAGCTCACATGAGGATCACCTATGTGAGCATCAAAGCTGCATTCTAGTTGTGGTTTTTTTTT (SEQ ID NO: 1836) |
| pSG181 | Scaffold 307 | ACTGGCGCTTTTATCTGATTACTTTGAGAGCCATCACCAGCGACTATGTCGTAGTGGGTAAAGCTCACATTAGGATCACCAATGTGAGCATCAAAGCTGCATTCTAGTTGTGGTTTTTTTTT (SEQ ID NO: 1837) |
| pSG182 | Scaffold 308 | ACTGGCGCTTTTATCTGATTACTTTGAGAGCCATCACCAGCGACTATGTCGTAGTGGGTAAAGCTCACATTAGGATCACCGATGTGAGCATCAAAGCTGCATTCTAGTTGTGGTTTTTTTTT (SEQ ID NO: 1838) |
| pSG183 | Scaffold 309 | ACTGGCGCTTTTATCTGATTACTTTGAGAGCCATCACCAGCGACTATGTCGTAGTGGGTAAAGCTCACATTAGGATCACCTATGTGAGCATCAAAGCTGCATTCTAGTTGTGGTTTTTTTTT (SEQ ID NO: 1839) |
| pSG184 | Scaffold 310 | ACTGGCGCTTTTATCTGATTACTTTGAGAGCCATCACCAGCGACTATGTCGTAGTGGGTAAAGCTCACATGAGGATTACCCATGTGAGCATCAAAGCTGCATTCTAGTTGTGGTTTTTTTTT (SEQ ID NO: 1840) |
| pSG185 | Scaffold 311 | ACTGGCGCTTTTATCTGATTACTTTGAGAGCCATCACCAGCGACTATGTCGTAGTGGGTAAAGCTCACATGAGGATAACCCATGTGAGCATCAAAGCTGCATTCTAGTTGTGGTTTTTTTTT (SEQ ID NO: 1841) |
| pSG186 | Scaffold 312 | ACTGGCGCTTTTATCTGATTACTTTGAGAGCCATCACCAGCGACTATGTCGTAGTGGGTAAAGCTCACATGAGGATGACCCATGTGAGCATCAAAGCTGCATTCTAGTTGTGGTTTTTTTTT (SEQ ID NO: 1842) |
| pSG187 | Scaffold 313 | ACTGGCGCTTTTATCTGATTACTTTGAGAGCCATCACCAGCGACTATGTCGTAGTGGGTAAAGCTCACATGAGGACCACCCATGTGAGCATCAAAGCTGCATTCTAGTTGTGGTTTTTTTTT (SEQ ID NO: 1843) |
| pSG188 | Scaffold 314 | ACTGGCGCTTTTATCTGATTACTTTGAGAGCCATCACCAGCGACTATGTCGTAGTGGGTAAAGCTCAGATGAGGATCACCCATGGGAGCATCAAAGCTGCATTCTAGTTGTGGTTTTTTTTT (SEQ ID NO: 1844) |
| pSG189 | Scaffold 315 | ACTGGCGCTTTTATCTGATTACTTTGAGAGCCATCACCAGCGACTATGTCGTAGTGGGTAAAGCTCACATGGGGATCACCCATGTGAGCATCAAAGCTGCATTCTAGTTGTGGTTTTTTTTT (SEQ ID NO: 1845) |

TABLE 91

MS2 hairpin variant sequences

| Scaffold No. | MS2 Sequences | SEQ ID NO |
|---|---|---|
| 188 | ACAUGAGGAUCACCCAUGU | 1846 |
| 251 | | |
| 296 | ACCUGAGGAUCACCCAGGU | 1847 |
| 297 | GCAUGAGGAUCACCCAUGC | 1848 |
| 298 | GCCUGAGGAUCACCCAGGC | 1849 |
| 299 | GCCUGAGCAUCAGCCAGGC | 1850 |
| 300 | ACAUGAGCAUCAGCCAUGU | 1851 |
| 304 | ACUUGAGGAUCACCCAUGU | 1852 |
| 307 | ACAUUAGGAUCACCAAUGU | 1853 |
| 313 | ACAUGAGGACCACCCAUGU | 1854 |

Materials and Methods:

All plasmids encoding CasX proteins pertain to CasX variant 491. All XDPs were pseudotyped with 10% VSV-G (percentage of VSV-G plasmid relative to other XDP structural plasmids). RNA fold structures were generated with RNAfold web server and VARNA software. The methods to produce XDPs are described herein, as well as in WO2021113772A1, incorporated by reference in its entirety.

Structural Plasmid Cloning:

Briefly, to generate the XDP structural plasmids, the Gag-pol sequence was removed from pXDP1, and amplified and purified fragments encoding CasX 491, HIV-1, or MS2 CP components were cloned as described in Example 7, above. Individual colonies were picked, miniprepped, and Sanger-sequenced for assembly verification. Plasmid sequences are listed in Table 90.

Guide Plasmid Cloning:

All guide plasmids containing MS2 RNA hairpin variants (Tables 90 and 91) incorporated the tdTomato targeting spacer 12.7 (CUGCAUUCUAGUUGUGGUUU; SEQ ID NO: 1855). The tdTomato targeting spacer was cloned as previously described. Briefly, the spacer was made by annealing two oligos and cloned via Golden Gate assembly with the appropriate restriction enzymes into a pSG plasmid with an alternate scaffold, as described in Example 7, above. Cloned spacers were subjected to transformation, miniprepping, and Sanger-sequencing for verification.

pGP2 Glycoprotein Plasmid Cloning:

Briefly, sequences encoding the VSV-G glycoprotein and CMV promoter and the backbone taken from a kanamycin-resistant plasmid were amplified and cloned as described in Example 7, above. Assembled products were transformed into chemically-competent Turbo Competent E. coli cells, plated on LB-Agar plates containing kanamycin and incubated at 37° C. Individual colonies were picked, miniprepped, and Sanger-sequenced for assembly verification.

XDP Production:

Briefly, HEK293T Lenti-X cells were seeded in 15 cm dishes at $20 \times 10^6$ cells per dish 24 hours before transfection to reach 70-90% confluency. The next day, Lenti-X cells were transfected with the following plasmids using PEI Max (Polypus): XDP structural plasmids (also encoding the CasX variants; Table 90), pSG50 (or other guide plasmid variants listed in Table 90), and pGP2 for XDP pseudotyping. 24 hours post-transfection, media was replaced with Opti-MEM (Thermo Fisher). XDP-containing media was collected 72 hours post-transfection and filtered through a 0.45 µm PES filter. The supernatant was concentrated and purified via centrifugation. XDPs were resuspended in 500 µL of DMEM/F12 supplemented with Glutamax, HEPES, NEAA, Pen/Strep, 2-mercaptoethanol, B-27 without vitamin A, and N2.

XDP Transduction of tdTomato Neural Progenitor Cells (NPCs):

tdTomato NPCs were grown in DMEM/F12 supplemented with Glutamax, HEPES, NEAA, Pen/Strep, 2-mercaptoethanol, B-27 without vitamin A, and N2. Cells were harvested using StemPro Accutase Cell Dissociation Reagent and seeded on PLF-coated 96-well plates. 48 hours later, cells were transduced with XDPs containing tdTomato targeting spacer, starting with a neat resuspended virus and proceeding through 5 half-log dilutions. Cells were then centrifuged for 15 minutes at 1000×g. Transduced NPCs were grown for 96 hours before analyzing tdTomato fluorescence by flow cytometry as a marker of editing at the tdTomato locus, with the EC50 determined as the number of XDP particles needed to achieve editing in 50% of the cells, as determined by flow cytometry. Assays were run 2-3 times for each sample with similar results.

Results:

V206 XDPs composed of Gag-MS2, Gag-pro, CasX, gRNA scaffold variants, and VSV-G were produced as version 206 either with the original MS2 (MS2 WT) or an MS2 high affinity variant (MS2 353). Produced XDPs were subsequently assessed for their editing efficiency at the tdTomato locus in NPCs. FIG. 111 shows the percent editing at the tdTomato locus as measured by tdTomato fluorescence using flow cytometry when 0.007 µL of concentrated XDP preps were used to transduce NPCs. In addition to the base control gRNA scaffolds 188 and 251, high affinity scaffold variants 296 and 298 demonstrated enhanced potency with both MS2 WT and MS2 353, with $K_D$ values ranging from 1.8 to 2.1 nM. Furthermore, medium affinity scaffold variants 303, 304, 305, 307, 310 and 313, with $K_D$ values ranging from 9.2 to 36.9 nM, resulted in promising editing efficiencies. FIG. 112 illustrates EC50 results across the different gRNA scaffolds incorporating the MS2 WT and MS 353 configurations. Scaffold variants 296, 297, and 305 exhibited a slightly higher potency compared to scaffold 188, an advantage that was more evident with the MS2 353 configuration. FIG. 113 shows a clear correlation between the affinity ($K_D$) of the gRNA MS2 hairpin and resulting XDP potency (EC50), with an $R^2$ value of 0.81 (p<0.001). XDP comprising MS2 having an affinity of <35 nM resulted in efficient recruitment and packaging of the CasX RNP into XDPs. However, there was no correlation observed between the affinity ($K_D$) of the gRNA MS2 hairpin and resulting XDP titer (FIG. 114).

Example 31: Engineering of XDPs with Cytokine Payload

Experiments were performed to demonstrate that XDPs can be used to carry the cytokine granulocyte-macrophage colony-stimulating factor (GM-CSF) as the therapeutic protein payload.

Methods:

Structural Plasmid Cloning

In order to generate the structural plasmids used to make the XDPs, mouse or human GMCSF was directly fused to a Gag structural protein, as described in Table 92, below. Cloning was performed as described in Example 7, above. The resultant plasmids were sequenced using Sanger sequencing to ensure correct assembly.

TABLE 92

Configurations of XDPs for carrying GM-CSF

| XDP description | Plasmid | Encoded Components** |
|---|---|---|
| ALV GM-CSF | 1 | MA-P2A-P2B-P10-CA-NC- Pro†-GMCSF |
|  | 2 | VSVG |
| Version 168-GM-CSF | 1 | MA*-CA*-NC*-p1*-p6*-GMCSF |
|  | 2 | MA*-CA*-NC*-p1*-p6*-Pro† |
|  | 3 | VSVG |
| VSV M-GM-CSF | 1 | MA-GMCSF |
|  | 2 | VSVG |

*indicates cleavage sequence between adjacent components
**5' to 3' orientation
†indicates a-1 frame-shift in the encoded construct (Gag-TFR-PR polyprotein)

Cell Culture and Transfection

HEK293T Lenti-X cell culture was performed as described in Example 7, above. For transfection, the XDP structural plasmids of Table 92 were used in amounts ranging from 13 to 80.0 µg.

Collection and Concentration

XDPs were collected and concentrated as described in Example 8, above.

Enzyme-Linked Immunosorbent Assays (ELISAs)

ELISAs were performed to measure the amount of GM-CSF per XDP. Specifically, XDPs were lysed with the lysis reagent and the number of GMCSF molecules packaged per XDP was quantified using the Mouse GMCSF Quantikine™ ELISA kit (R&D, Cat no. MGM00) and Human GMCSF Quantikine™ ELISA kit (R&D, Cat no. DGM00) as per the manufacturer's instruction.

Results:

XDPs were engineered to carry human or mouse GM-CSF via the direct fusion of GM-CSF to the protein scaffold, and the amount of GM-CSF per XDP was measured via ELISA. As shown in Table 93, below, the XDPs contained GM-CSF, with between 40-527 molecules of GM-CSF per XDP.

TABLE 93

Number and concentration of GM-CSF molecules in XDPs

| GM-CSF species | XDP description | Molecules of GM-CSF/XDP |
| --- | --- | --- |
| Mouse | ALV GM-CSF | 46 |
|  | V168-GM-CSF | 35 |
|  | VSV M-mGM-CSF | 149 |
| Human | ALV GM-CSF | 101 |
|  | V168-GM-CSF | 527 |
|  | VSV M-mGM-CSF | 40 |

Example 32: Engineering of XDPs for Carrying Catalytically-Dead CasX Repressor (dXR) System Experiments were performed to demonstrate that XDPs can be used to carry a catalytically-dead CasX repressor (dXR) system as the payload.

Methods:
Structural Plasmid Cloning

XDPs were generated using the version 168 or version 206 configuration.

Cloning was performed as described in Example 7, above. The constructs were designed with sequences coding for catalytically-dead CasX protein 491 (dCasX491; SEQ ID NO: 1940) linked to the ZNF10 KRAB domain or the ZIM3 KRAB domain, along with guide RNA scaffold variant 226 or 251, and spacer sequence 7.37 targeted to human B2M 7.37 (GGCCGAGATGTCTCGCTCCG, SEQ ID NO: 1017) or a non-targeting spacer (CGAGACGTAATTACGTCTCG; SEQ ID NO: 1019). The amino acid sequences of the dXR constructs are provided in Table 94, below. The resultant plasmids were sequenced using Sanger sequencing to ensure correct assembly.

TABLE 94

Amino acid sequences of dXR constructs

| XDP version | Plasmid number | Description | Amino Acid Sequence |
| --- | --- | --- | --- |
| 318 | pXDP538 | V168-XR.ZIM3 | 35067 |
| 319 | pXDP539 | V168-XR.ZNF10 | 35068 |
| 320 | pXDP540 | V206-XR.ZIM3 | 35069 |
| 321 | pXDP541 | V206-XR.ZNF10 | 35070 |

Cell Culture and Transfection

HEK293T Lenti-X cell culture was performed as described in Example 7, above.

Collection and Concentration

XDPs were collected and concentrated as described in Example 8, above.

Results:

XDPs were engineered to carry a dXR system targeting the B2M locus for repression. The XDPs were administered to human NPCs, and the level of B2M repression was measured. As shown in FIG. 116, both the version 168 and version 206 XDPs were able to induce repression of B2M. The version 206 XDP with dCasX491 linked to the Zim3 KRAB domain produced the highest level of repression.

The results of the experiments support that XDPs can be generated carrying functional dXR systems for inducing targeted gene repression.

Example 33: Quantification of CasX Ribonucleoproteins (RNPs) in XDPs

Experiments were performed to measure the amount of CasX RNPs in XDPs.

Methods:

XDPs were generated using the version 168 configuration with guide scaffold 226, or the version 206 configuration with guide scaffold 251 (see FIG. 46) or guide scaffold 188 (see FIG. 32).

Cloning was performed as described in Example 7, above. The resultant plasmids were sequenced using Sanger sequencing to ensure correct assembly.

Cell Culture and Transfection

HEK293T Lenti-X cell culture was performed as described in Example 7, above.

Collection and Concentration

XDPs were collected and concentrated as described in Example 8, above.

Quantification of CasX RNPs Via Western Blot Analysis:

To determine the number of CasX molecules per XPD particle, a semi-quantitative Western blot analysis was performed using XDP version 206 with guide scaffold 251, XDP version 168 with guide scaffold 226, and version XDP version 206 with guide scaffold 188 (FIG. 117). The protein amount in XPD particles was measured using a Pierce 660 assay. XPD particles were lysed in Laemmli sample buffer and resolved by SDS-PAGE followed by Western blotting using a polyclonal antibody against the CasX protein. The gel also contained a range of purified CasX to establish a standard curve, shown in FIG. 118. The resulting immunoblot was imaged using a ChemiDoc Touch, and the CasX protein levels were quantified by densitometry using Image Lab software from BioRad. Quantification of the CasX molecules in each XDP particle sample was determined using the standard curve.

Results:

Results of the Western blot analysis demonstrated that XDP version 168 with guide scaffold 226 contained approximately 227-239 CasX molecules/XDP particle (FIG. 119). The XDP version 206 with guide scaffold 188 contained approximately 240-257 CasX molecules/XDP particle, and XDP version 206 with guide scaffold 251 contained approximately 966-1112 CasX molecules/XDP particle. The fold differences relative to XDP version 168 with guide scaffold 226 are shown in FIG. 120.

Example 34: Evaluation of Orthogonal Recruitment System with MS2 Linked to Gag Plus a Nuclear Export Signal (NES) Linked to CasX The purpose of these experiments was to evaluate whether linking cleavable nuclear export signals (NESs) to CasX in an XDP construct could prevent the sequestration of CasX in the nucleus in packaging cells and promote the packaging of CasX RNPs into XDPs. A potential concern during XDP production is the sequestration of the CasX RNP in the nucleus of the producer cell line as a result of the strong nuclear localization signals on the CasX protein. This possible nuclear sequestration might affect RNP packaging into XDPs and therefore XDP editing potency. Therefore, the use of adding cleavable nuclear export signals (NESs) to CasX in an XDP construct so as to prevent the sequestration of CasX in the nucleus in packaging cells and promote the packaging of CasX RNPs into XDPs was evaluated.

Methods:

Cleavable NESs were added to the XDP version 206 system (plasmid configurations are shown in Table 95. The NESs were linked to the C-terminus of CasX 676 via an HIV cleavage sequence and a rigid linker.

TABLE 95

Configurations of version 206 XDPs with or without NESs

| XDP description | Plasmid | Encoded Components** |
|---|---|---|
| Version 206 | 1 | MA*-CA*-NC*-p1*-p6*-MS2 |
| | 2 | MA*-CA*-NC*-p1*-p6*-Pro† |
| | 3 | NLS-CasX-NLS |
| | 4 | sgRNA (scaffold 251) |
| Version 206 with NES | 1 | MA*-CA*-NC*-p1*-p6*-MS2 |
| | 2 | MA*-CA*-NC*-p1*-p6*-Pro† |
| | 3 | NLS-CasX-NLS*-NES |
| | 4 | sgRNA (scaffold 251) |

*indicates cleavage sequence between adjacent components
**5' to 3' orientation
†indicates a-1 frame-shift in the encoded construct (Gag-TFR-PR polyprotein)

CRM1 (chromosomal Maintenance 1) plays a major role in the export of proteins with leucine-rich nuclear export signals. Nuclear export signals that utilize the CRM1 nuclear export pathway with a range of affinities were selected and attached to the C-terminus of CasX in cleavable manner, such that during the maturation process post XDP budding, the HIV protease would cleave the NES such that the CasX RNP would not have an attached NES when delivered into the target cell. Specifically, 15 different NESs that use the CRM1 pathway with different Rc/n and Kd values were selected (see Fu, S. et al., *Mol Biol Cell.* 2018 Aug. 15; 29(17):2037-2044), and six additional NESs were selected from NESdb, a database of NES-containing CRM1 cargoes (see Xu, D., et al. *Mol Biol Cell.* 2012 September; 23(18):3673-6). The amino acid sequences of the nuclear export signals are listed in Table 96, below. Further nuclear export signals have been identified for future testing, and are also listed in Table 96.

TABLE 96

Sequences of nuclear export signals (NESs)

| Source of NES | Amino acid sequence of NES | SEQ ID NO |
|---|---|---|
| PKI | NSNELALKLAGLDINK | 35071 |
| CPEB4 | RTFDMHSLESSLIDIMR | 35072 |
| MEK1 | TNLEALQKKLEELELDE | 35073 |
| ADAR1 | RGVDCLSSHFQELSIYQ | 35074 |
| FMRP | RSFEMTEFNQALEEIKG | 35075 |
| hRio2 | LKEVDQLRLERLQID | 35076 |
| Super PKI | NLNELALKLAGLDINK | 35077 |
| X11L2 | SSLQELVQQFEALPGDLV | 35078 |
| SMAD4 | ERVVSPGIDLSGLTLQ | 35079 |
| HDAC5 | EAETVSAMALLSVG | 35080 |
| SNUPN | MEELSQALASSFSVSQDLNS | 35081 |
| REV | LQLPPLERLTLDC | 35082 |
| MVM NS2 | STVDEMTKKFGTLTIHD | 35083 |
| HPV E7 | HVDIRTLEDLLMGTLGIVC | 35084 |
| Pax | RELDELMASLSDFKFMA | 35085 |
| P53 | EMFRELNEALELKD | 35086 |
| NMD3 | RERENMDTDDERQYQDFLEDLEEDEAIRKNVNIYRDSAIPVESDTDDEGAPRISLAEMLEDLHISQDATGEEGASMLT | 35087 |
| Rex | ALSAQLYSSLSLDS | 35088 |
| IκBα | MFQAAERPQEWAMEGPRDGLKKERLLDDRHDSGLDSMKDEEYEQMVKELQEIRLE | 35089 |

TABLE 96-continued

Sequences of nuclear export signals (NESs)

| Source of NES | Amino acid sequence of NES | SEQ ID NO |
|---|---|---|
| NFE2L2 | FLNAFEDSFSSILS | 35090 |
| MLXIP | IDASLTKLFECMTLAY | 35091 |
| Influenza NP | MIDGIGRFYI | 35092 |
| NPM mutant E | DLWQSLAQVSLRK | 35093 |
| Rabies P | EVDNLPEDMKRLHLDD | 35094 |
| IRF3 | QEDILDELLGNMVLA | 35095 |
| NS2 | LVSLIRLKSKL | 35096 |
| Tax-1 | YKRIEELLYKISLTT | 35097 |
| Nucleocapsid N protein of PRRSV | CTLSDSGRISYTVEFSLPTHHTVRLIRVTASPSA | 35098 |
| ICP27 | LEELCAARRLSL | 35099 |
| Adenoviral E1A | VSQIFPDSVMLAVQEGIDLL | 35100 |
| BIRC2 | PNCPFLENSLETLRFSISNLSMQ | 35101 |
| CALM | LDSSLANLVGNLGIGNGT | 35102 |
| BVP-1 E1 protein | ELITFINALKL | 35103 |
| X protein of BDV | LRLTLLELVRRL | 35104 |
| HBZ | MVNFVSVGLFRCLPVPCPEDLLVEELVDGLLSL | 35105 |
| Influenza M1 | LFGDTIAYLLSL | 35106 |
| HPV 11 E1 | ISPRLDAIKL | 35107 |
| Menin | DLVLLSLVL | 35108 |
| mRNA export factor EB2 | PVSKITFVTL | 35109 |
| Nucleoprotein-Porcine epidemic diarrhea virus | LAPNVAALLFGGNVAVRELADSYEITYNYKMTVPKSDPNV | 35110 |
| Nuclear export protein-Influenza A virus | ILMRMSKMQL | 35111 |
| NS-2 of MVM | DEMTKKFGTLTIHDTEKYASQPELCNN | 35112 |
| Paxillin | QRVTSTQQQTRISASSATRELDELMASLSDFKFMAQGKTGSSSPP GGPPKPGSQLDSMLGSLQSDLNKLGV | 35113 |
| Phosphoprotein of hPIV-2 | IIELLKGLDL | 35114 |
| HCMV Protein UL94 | CILCQLLLLY | 35115 |
| VEEV Capsid protein | TDPFLAMQVQELTRSMANLTFKQRRDAPPEGPSAKKPKK | 35116 |
| VP1 of CAV | ELDTNFFTLYVAQG | 35117 |
| triplex capsid protein VP19C-Human herpesvirus 1 (strain F)(HHV-1) (Human herpes simplex virus 1) | LERLFGRLRI | 35118 |

TABLE 96-continued

Sequences of nuclear export signals (NESs)

| Source of NES | Amino acid sequence of NES | SEQ ID NO |
|---|---|---|
| cGAS | EQCERA | 35119 |
| cGAS | LEKLKL | 35120 |

The XDPs were transduced into human Jurkat T cells or neural progenitor cells (NPCs), and editing of the B2M locus was measured.

Results

Overall, of the 21 nuclear export signals tested, about 10 showed improvements in editing, which suggests that they improved packaging of CasX RNPs into the XDPs. Specifically, the nuclear export signals that worked the best in Jurkat and/or NPCs were hRIO2, iKbA, MEK1, P53, Pax, PK1, Rex, Smad4, CPEB4, ADAR1, FMRP and SNUPN (FIGS. 121-123).

Example 35: Screen of Viral-Like Particles Based on HIV (XDPs) with Diverse Incorporated Viral Glycoproteins to Evaluate Tropism and Editing Capabilities The glycoprotein belonging to VSV Indiana species within the Vesiculovirus genus is usually the most widely used glycoprotein for pseudotyping purposes. The purpose of these experiments was to explore the transduction capabilities of glycoproteins belonging to other species and test whether the cellular tropism of XDPs could be altered by pseudotyping XDPs with various glycoproteins as targeting moieties.

Methods:

The screen of glycoproteins was conducted in the XDP version 206 construct configuration. The version 206 XDPs pseudotyped with glycoproteins of Table 97 were transduced into mouse tdTomato neural progenitor cells in which editing of the tdTomato locus was measured, or human Jurkat T cells, neural progenitor cells, or astrocytes in which editing of the B2M locus was measured.

The amino acid sequences of the glycoproteins tested are provided in Table 97, below.

TABLE 97

| Glycoprotein | Amino acid sequence of glycoprotein (N-C terminus) | SEQ ID NO |
|---|---|---|
| VSVG | MKCLLYLAFLFIGVNCKFTIVFPHNQKGNWKNVPSNYHYCPSSSDLNWHNDLIGT ALQVKMPKSHKAIQADGWMCHASKWVTTCDFRWYGPKYITHSIRSFTPSVEQCKE SIEQTKQGTWLNPGFPPQSCGYATVTDAEAVIVQVTPHHVLVDEYTGEWVDSQFI NGKCSNYICPTVHNSTTWHSDYKVKGLCDSNLISMDITFFSEDGELSSLGKEGTG FRSNYFAYETGGKACKMQYCKHWGVRLPSGVWFEMADKDLFAAARFPECPEGSSI SAPSQTSVDVSLIQDVERILDYSLCQETWSKIRAGLPISPVDLSYLAPKNPGTGP AFTIINGTLKYFETRYIRVDIAAPILSRMVGMISGTTTERELWDDWAPYEDVEIG PNGVLRTSSGYKFPLYMIGHGMLDSDLHLSSKAQVFEHPHIQDAASQLPDDESLF FGDTGLSKNPIELVEGWFSSWKSSIASFFFIIGLIIGLFLVLRVGIHLCIKLKHT KKRQIYTDIEMNRLGK | 35121 |
| VSAV | MTPAFILCMLLAGSSWAKFTIVFPQSQKGDWKDVPPNYRYCPSSADQNWHGDLLG VNIRAKMPKVHKAIKADGWMCHAAKWVTTCDYRWYGPQYITHSIHSFIPTKAQCE ESIKQTKEGVWINPGFPPPKNCGYASVSDAESIIVQATAHSVMIDEYSGDWLDSQF PTGRCTGSTCETIHNSTLWYADYQVTGLCDSALVSTEVTFYSEDGLMTSIGRQNT GYRSNYFPYEKGAAACRMKYCTHEGIRLPSGVWFEMVDKELLESVQMPECPAGLT ISAPTQTSVDVSLILDVERMLDYSLCQETWSKVHSGLPISPVDLGYIAPKNPGAG PAFTIVNGTLKYFDTRYLRIDIEGPVLKKMTGKVSGTPTKRELWTEWFPYDDVEI GPNGVLKTPEGYKFPLYMIGHGLLDSDLQKTSQAEVFHHPQIAEAVQKLPDDETL FFGDTGISKNPVEVIEGWFSNWRSSVMAIVFAILLLVITVLMVRLCVAFRHFCCQ KRHKIYNDLEMNQLRR | 35122 |
| ABVV | MVRIICWLGLVLSVQAAKVILPVKLESDWVPVYSGERICQSHREKIPPGIYESLK VEGQVPVRQQSQGADGYYCHKTIYSVLCDFKWYGVKRVRHSVKRDTPSYSECLKA VDDEISGMSEYVGFPPPSCNYLVETRSQNIEIILSKHSVKIDDYKQSWMDSTFLD GGCSHAPCLTTVPGTLWIPTDNLTSACDITFRKQEFTIYYPKQKPAHLSSDQIFI TSPYHPVSSLSKSCLITLCGKTGIRLPGGSWSSLDNHKSFHDIKIETLLSNCKSS TEIYSSPPPDLRNIRMVWDLERVIENSLCQGTWDKIETRQKITPLDLNYLSPSEPG PGWGFIPKNGSIHKAQILYIRADVDDDTIALGQKYNKGKDEFYFNWNDWELLNGI KIGPNGIITNTHVRIPYYSVGIGKLDEDMITPDEVGVIHHIDHLKQRVLVQTNLD RVWIHEGENGDLITSVSHWWHDVIKHSWEIFALIGGLFSLSCICSLCSCRKKRRE SRHQETMSFV | 35123 |
| CARV | MKMKMVIAGLILCIGILPAIGKITISFPQSLKGDWRPVPKGYNYCPTSADKNLHG DLIDIGLRLRAPKSFKGISADGWMCHAARWITTCDFRWYGPKYITHSIHSFRPSN DQCKEAIRLTNEGNWINPGFPPQSCGYASVTDSESVVVTVTKHQVLVDEYSGSWI DSQFPGGSCTSPICDTVHNSTLWHADHTLDSICDQEFVAMDAVLFTESGKFEEFG KPNSGIRSNYFPYESLKDVCQMDFCKRKGFKLPSGVWFEIEDAEKSHKAQVELKI | 35124 |

TABLE 97-continued

Description of glycoproteins tested

| Glyco-protein | Amino acid sequence of glycoprotein (N-C terminus) | SEQ ID NO |
|---|---|---|
| | KRCPHGAVISAPNQNAADINLIMDVERILDYSLCQATWSKIQNKEALTPIDISYL GPKNPGPGPAFTIINGTLHYFNTRYIRVDIAGPVTKEITGFVSGTSTSRVLWDQW FPYGENSIGPNGLLKTASGYKYPLFMVGTGVLDADIHKLGEATVIEHPHAKEAQK VVDDSEVIFFGDTGVSKNPVEVVEGWFSGWRSSLMSIFGIILLIVCLVLIVRILI ALKYCCVRHKKRTIYKEDLEMGRIPRRA | |
| CHPV | MTSSVTISVILLISFIAPSYSSLSIAFPENTKLDWKPVTKNTRYCPMGGEWFLEP GLQEESFLSSTPIGATPSKSDGFLCHAAKWVTTCDFRWYGPKYITHSIHNIKPTR SDCDTALASYKSGTLVSPGFPPESCGYASVTDSEFLVIMITPHHVGVDDYRGHWV DPLFVGGECDQSYCDTIHNSSVWIPADQTKKNICGQSFTPLTVTVAYDKTKEIAA GAIVFKSKYHSHMEGARTCRLSYCGRNGIKFPNGEWVSLDVKTKIQEKPLLPLFK ECPAGTEVRSTLQSDGAQVLTSEIQRILDYSLCQNTWDKVERKEPLSPLDLSYLA SKSPGKGLAYTVINGTLSFAHTRYVRMWIDGPVLKEMKGKRESPSGISSDIWTQW FKYGDMEIGPNGLLKTAGGYKFPWHLIGMGIVDNELHELSEANPLDHPQLPHAQS IADDSEEIFFGDTGVSKNPVELVTGWFTSWKESLAAGVVLILVVVLIYGVLRCFP VLCTTCRKPKWKKGVERSDSFEMRIFKPNNMRARV | 35125 |
| COCV | MNFLLLTFIVLPLCSHAKFSIVFPQSQKGNWKNVPSSYHYCPSSSDQNWHNDLLG ITMKVKMPKTHKAIQADGWMCHAAKWITTCDFRWYGPKYITHSIHSIQPTSEQCK ESIKQTKQGTWMSPGFPPQNCGYATVTDSVAVVVQATPHHVLVDEYTGEWIDSQF PNGKCETEECETVHNSTVWYSDYKVTGLCDATLVDTEITFFSEDGKKESIGKPNT GYRSNYFAYEKGDKVCKMNYCKHAGVRLPSGVWFEFVDQDVYAAAKLPECPVGAT ISAPTQTSVDVSLILDVERILDYSLCQETWSKIRSKQPVSPVDLSYLAPKNPGTG PAFTIINGTLKYFETRYIRIDIDNPIISKMVGKISGSQTERELWTEWFPYEGVEI GPNGILKTPTGYKFPLFMIGHGMLDSDLHKTSQAEVFEHPHLAEAPKQLPEEETL FFGDTGISKNPVELIEGWFSSWKSTVVTFFFAIGVFILLYVVARIVIAVRYRYQG SNNKRIYNDIEMSRFRK | 35126 |
| VSIV | MKCLLYLAFLSIGVNCKFTIVFPHNQKGTWKNVPSNYHYCPSSSDLNWHNDLIGT ALQVKMPKSHKAIQADGWMCHASKWVTTCDFRWYGPKYITHSIRSFTPSVEQCRE SIEQTKQGTWLNPGFPPQSCGYATVTDAEAVIVQVTPHHVLVDEYTGEWVDSQFI NGKCSNDICPTVHNSTTWHSDYKVKGLCDSNLISMDITFFSEDGELSSLGKEGTG FRSNHFAYETGDKACKMQYCKHWGVRLPSGVWFEMADQDLFAAARFPECPEGSSI SAPSQTSVDVSLIQDVERILDYSLCQETWSKIGAGLPISPVDLSYLAPKNPGTGP AFTIINGTLKYFETRYIRVDIAAPILSRMVGMISGTTTERELWDDWAPYEDVEIG PNGVLRTSSGYKFPLYMIGHGMLDSDLHLSSKAQVFEHPHIQDAASQLPDDETLF FGDTGLSKNPIELVEGWFSGWKSSIASFFFIIGLIIGLFLVLRVGIYLCIKLKHT KKRQIYTDIEMNRLGK | 35127 |
| ISFV | MTSVLFMVGVLLGAFGSTHCSIQIVFPSETKLVWKPVLKGTRYCPQSAELNLEPD LKTMAFDSKVPIGITPSNSDGYLCHAAKWVTTCDFRWYGPKYITHSVHSLRPTVS DCKAAVEAYNAGTLMYPGFPPESCGYASITDSEFYVMLVTPHPVGDDYRGHWVD PLFPTSECNSNFCETVHNATMWIPKDLKTHDVCSQDFQTIRVSVMYPQTKPTKGA DLTLKSKFHAHMKGDRVCKMKFCNKNGLRLGNGEWIEVGDEVMLDNSKLLSLFPD CLVGSVVKSTLLSEGVQTALWETDRLLDYSLCQNTWEKIDRKEPLSAVDLSYLAP RSPGKGMAYIVANGSLMSAPARYIRVWIDSPILKEIKGKKESASGIDTVLWEQWL PFNGMELGPNGLIKTKSGYKFPLYLLGMGIVDQDLQELSSVNPVDHPHVPIAQAF VSEGEEVFFGDTGVSKNPIELISGWFSDWKETAAALGFAAISVILIIGLMRLLPL LCRRRKQKKVIYKDVELNSFDPRQAFHR | 35128 |
| JURV | MESLPFSALLAVLSITLCDSAIPIFFPSEPQLEWKPVLPGSRYCPQSNEMSLDPD LKKSTISVKVPIGVTPSKSDGYLCHGAKWVSTCDFRWYGPKYITHSIHNLRPTTN DCEDAIKKYEAGTLINPGFPPDSCAYATVTDSEHLVILITPHHVGVDDYRGAWVD DSFPSGVCETNQCDTTHNSSIWIPKTKTRHNICSQTFANLSVTISYREGGAMKGA DMVFHSKYHPHMVGGHICKMNFCNKQGLRLQNEEWIEIPSGTKVGNQDLMNLFSD CKSGLEVRSTLRSEGANTLTWETQRLLDYALCQNTWDKFDNQGAVSALDLSYLAA RAPGKGVAYTMINGTLHSAPTRYVRMWIESPSMEELKAKKESSSGVETSIWNQWF PFKGGEIGPNGLIKAGNKYKFPLYLVGMGMLDDEINALELGGPIDHPQRAHAQAV LGDEETLFFGDTGVGKNPVELITGWFSGWKETIMAVVAIFLLVIVLYGVLRCCPT ICVLCKRKSRHRTKDMEMQYIPNNQRHWR | 35129 |
| MSPV | MESLLKAICVLLLIHCSRCDLPIVFPDQKELLWNPVLKTNRYCPQTREIAPLDKP KTLKITTGVPVRSPKEKIEGYLCHSGKWVTTCDYRWYGAKYVTHSIHHLKPTDQM CRDAISQYNGGTLLNPGFPPEVCGYASVTDSELIITLITPHTVGVDDYRGLWIDP SFPNGECNSIVCETIHNSTKWVSKGEMPTDICQQTFTTIKMDVSYPSDTTSQGSL LSFHSPYHPHISGKDICKMSYCGSNGLRLPNGEWFSIINTSKIGNKNLIDFFSPC KAGVEVRSTLQSEGSQTIAWETQRMLDYALCQNTWDKFERGEPLSPLDLNYLAPR VPGKGMAYTIINNTLHSSHAVYRRVWIEGPIIGEMKGKIESATGVAKEIWAQWFE FGQNKIGPNGVIKTNDGIKFPLYAIGTGLIDQDIHELSEVSPMDHPHLVHAKKYV SEDDEIYFGDTGVSHNPVEIFSGWFTNWKEGLMKFSILVLSILIFYVVIRLVMCI PLKCKKERKPRLEFELQPREWEYSRA | 35130 |
| MARV | MLRLFLFCFLALGAHSKFTIVFPHHQKGNWKNVPSTYHYCPSSSDQNWHNDLTGV SLHVKIPKSHKAIQADGWMCHAAKWVTTCDFRWYGPKYITHSIHSMSPTLEQCKT SIEQTKQGVWINPGFPPQSCGYATVTDAEVVVVQATPHHVLVDEYTGEWIDSQLV | 35131 |

TABLE 97-continued

Description of glycoproteins tested

| Glyco-protein | Amino acid sequence of glycoprotein (N-C terminus) | SEQ ID NO |
|---|---|---|
| | GGKCSKEVCQTVHNSTVWHADYKITGLCESNLASVDITFFSEDGQKTSLGKPNTG FRSNHFAYESGEKACRMQYCTQWGIRLPSGVWFELVDKDLFQAAKLPECPRGSSI SAPSQTSVDVSLIQDVERILDYSLCQETWSKIRAKLPVSPVDLSYLAPKNPGSGP AFTIINGTLKYFETRYIRVDISNPIIPHMVGTMSGTTTERELWNDWYPYEDVEIG PNGVLKTPTGFKFPLYMIGHGMLDSDLHKSSQAQVFEHPHAKDAASQLPDDETLF FGDTGLSKNPVELVEGWFSSWKSTLASFFLIIGLGVALIFIIRIIVAIRYKYKGR KTQKIYNDVEMSRLGNK | |
| MORV | MLVLYLLLSLLALGAQCKFTIVFPHNQKGNWKNVPANYQYCPSSSDLNWHNGLIG TSLQVKMPKSHKAIQADGWMCHAAKWVTTCDFRWYGPKYVTHSIKSMIPTVDQCK ESIAQTKQGTWLNPGFPPQSCGYASVTDAEAVIVKATPHQVLVDEYTGEWVDSQF PTGKCNKDICPTVHNSTTWHSDYKVTGLCDANLISMDITFFSEDGKLTSLGKEGT GFRSNYFAYENGDKACRMQYCKHWGVRLPSGVWFEMADKDIYNDAKFPDCPEGSS IAAPSQTSVDVSLIQDVERILDYSLCQETWSKIRAHLPISPVDLSYLSPKNPGTG PAFTIINGTLKYFETRYIRVDIAGPIIPQMRGVISGTTTERELWTDWYPYEDVEI GPNGVLKTATGYKFPLYMIGHGMLDSDLHISSKAQVFEHPHIQDAASQLPDDETL FFGDTGLSKNPIELVEGWFSGWKSTIASFFFIIGLVIGLYLVLRIGIALCIKCRV QEKRPKIYTDVEMNRLDR | 35132 |
| VSNJV | MLSYLIFALVVSPILGKIEIVFPQHTTGDWKRVPHEYNYCPTSADKNSHGTQTGI PVELTMPKGLTTHQVDGFMCHSALWMTTCDFRWYGPKYITHSIHNEEPTDYQCLE AIKAYKDGVSFNPGFPPQSCGYGTVTDAEAHIVTVTPHSVKVDEYTGEWIDPHFI GGRCKGQICETVHNSTKWFTSSDGESVCSQLFTLVGGTFFSDSEEITSMGLPETG IRSNYFPYVSTEGICKMPFCRKPGYKLKNDLWFQITDPDLDKTVRDLPHIKDCDL SSSIVTPGEHATDISLISDVERILDYALCQNTWSKIEAGEPITPVDLSYLGPKNP GAGPVFTIINGSLHYFMSKYLRVELESPVIPRMEGKVAGTRIVRQLWDQWFPPFGE VEIGPNGVLKTKQGYKFPLHIIGTGEVDNDIKMERIVKHWEHPHIEAAQTFLKKD DTEEVLYYGDTGVSKNPVELVEGWFSGWRSSIMGVLAVIIGFVILIFLIRLIGVL SSLFRQKRRPIYKSDVEMAHFR | 35133 |
| PERV | MSSKIVLAAICLCSVQYVACSFQIVFPEFNNAAWLPYLKTSRYCPQSAEMEFERR VSTTLLSADVPIGVTPTKSDGYLCHAAKWVTTCDFRWYGPKYVTHSIHDLTPAQV DCHEALARYKAGTLFNPGFPPASCGYATITDSEQKVVMITPHHVGIDDYRGKWID PIFPGGECTTNYCETLHNSSVWLPADEKIVDICAQTFRKIKVTATYPSEGAVTKE TISLHSAYHPHVPGTGICRMTYCSKEGLRLPNGEWLGIFYDNRIKTTDVRTVFPA CPDGLEVKSTLNSDGANTIAWETQRMLDYALCQSTWDKVQNKEPLSAVDLSYLSA RSPGKGLAYTVINGTLHFAHVRYVRTWIDGPVLKDLKGSRFDPTAAQKTLWDQWF PFGSNEIGPNGLLKTPKDFKFPLYIIGTGLVDEDLQELSEAGPIDHPQIPDASGI LPNSEQVYYGDTGVSKNPIELIEGWFANWKETVMSIVGLVLLITIVFTVLKCIGT CRSLRRKRKIEKDIELQEIGPYQPTTYRPR | 35134 |
| PIRYV | MDLFPILVVVLMTDTVLGKFQIVFPDQNELEWRPVVGDSRHCPQSSEMQFDGSRS QTILTGKAPVGITPSKSDGFICHAAKWVTTCDFRWYGPKYITHSIHHLRPTTSDC ETALQRYKDGSLINLGFPPESCGYATVTDSEAMLVQVTPHHVGVDDYRGHWIDPL FPGGECSTNFCDTVHNSSVWIPKSQKTDICAQSFKNIKMTASYPSEGALVSDRFA FHSAYHPNMPGSTVCIMDFCEQKGLRFTNGEWMGLNVEQSIREKKISAIFPNCVA GTEIRATLESEGARTLTWETQRMLDYSLCQNTWDKVSRKEPLSPLDLSYLSPRAP GKGMAYTVINGTLHSAHAKYIRTWIDYGEMKEIKGGRGEYSKAPELLWSQWFDFG PPFKIGPNGLLHTGKTFKFPLYLIGAGIIDEDLHELDEAAPIDHPQMPDAKSVLPE DEEIFFGDTGVSKNPIELIQGWFSNWRESVMAIVGIVLLLIVVTFLAIKTVRVLNC LWRPRKKRIVRQEVDVESRLNHFEMRGFPEYVKR | 35135 |
| RADV | MISITFVYLIIILSLSWGEMMIPFPDVTTTTWKPVLKGEHHCPSSSDVDILSRMS TLKLQVRIPTGSVASKSDGLLCHGAKWVTTCDFRWYGSKYITHSLHSIRPTLSQC TEAAKAYKEGRLMAPGFPPESCGWNSVTDSELLSILVTPHHTGVDDYRGIWIDSM FPGGECKEMVCDTVQGHTIWMSTSNLTTACGVAFKQIQGQFYYLNSGHQPNKEGT FFHSPNHPNSPLSTACRKKYCNQEGIVIHTGEWIGVPWNTRIRDVQLDSYTDLCA ESTEIKSTIGSAPIRVIAWEMERVMDFALCQTVWDKVNRGDPLSPLDLSYLSSRA PGKGLAYTIINETLHVAHVRYIRTYIKAPIMEEIKGSRGDRSAAESVLWTQWFPY GDGEIGPNGLLKTNGSFKFPFYLVGMGAIDDDLIELSNADPIDHPQKAIASVHLN TDEELFFGNTGSDSNPVEAVEGWFPASWKSAGINMALIVLCVLLVLIFLRSLPALI KLIHRYRVSRSRQTDVELNSINETARTGSVGPDIIPGAWRVHDSGVRQSQFFRNN PRRLGP | 35136 |
| YBV | MISSSTLILVIISAHAFCDMIIPFPDVTTTSWKPVLRGEHHCPASNDLDMAGGLST LKMNVKIPSGVVGSKSDGYLCHGAKWVTTCDYRWYGAKYITHSLHPLRPSTSQCF DAIKAYREGTLLSPGFPPESCGWNSVTDSELLSIQITPHHSGVDDYRGVWIDSMF PKGECDQRICDTVQEHSIWIAANNVSSACSIAFKQLEGYFYYRNSGIQPNKDGTF FHSSHHPNSPMSSCCRIKYCNQEGLRLHTGEWIGVAWNTKIRDVTLDSYTDTCPG GTEVKSTIGSSPTRVVAWEMERIMDFALCQNVWDKVNRGEQLSPLDLSYLSSRAP GKGLAYTIINETLHVAHVRYIRTWIKGPVLKEIKGRRGSSSAAEDTLWIQWFPFG DNQIGPNGLLKSNGTFKFPPFYLVGVGALDEDLIEMANADPVDHLQRVDAETHMRG DEELFFGDTGVSKNPIESVEGWFSNWISGLFNISIIVLCVLSVLIVFKSVITLIR VVRRRRRPRAEEDVELNNMNPRPQTRQPVGAPNIIPGAWGIQPSHGRGVRQSQFV KRSALNIVT | 35137 |

TABLE 97-continued

Description of glycoproteins tested

| Glyco-protein | Amino acid sequence of glycoprotein (N-C terminus) | SEQ ID NO |
|---|---|---|
| VSV CEN AM-94GUB | MKCLLYLALLFIGVYCKFTTVFPHNKKGDWKNVPSNYHYCPSSSDLNWHNDLIGT ALQVKMPKSHKAIQADGWMCHASKWVTTCDFRWYGPKYITHSIRSFTPSVEQCKE SIEQTKQGTWLNPGFPPQSCGYATVTDAEAVIVQVTPHHVLVDEYTGEWVDSQFI NGKCSDDICPTVHNSTTWHSDYKVKGLCDSNLISMDITFFSEDGELSSLGKEGTG FRSNYFAYETGDKACKMQYCKHWGVRLPSGVWFEMADKNLFAAAKFPECPEGSSI SAPSQTSVDVSLIQDVERILDYSLCQETWSKIRAGLPISPVDLSYLAPKNPGTGP AFTIINGTLKYFETRYIRVDIAAPILSRMVGMISGTTTERELWEDWAPYEDVEIG PNGVLRTSSGYKFPLYMIGHGMLDSDLHLSSKAQVFEHPHIPDATSQLPDDETLF FGDTGLSKDPIELVEGWFSGWKSSIASFFFIIGLIIGLFFVLRIGVYLCIKLKHT NKRQIYTDIEMNRLGK | 35138 |
| VSV South America 85CLB | MKCLLCLAFLFIGVNCKFTIVFPHNQKGNWKNVPSNYHYCPSSSDLNWHNDLIGT ALQVKMPKSHKAIQADGWMCHASKWITTCDFRWYGPKYITHSIQSFTPSVEQCKE SIEQTKQGTWLNPGFPPQSCGYATVTDAEAVIVQVTPHHVLVDEYTGEWVDSQFI NGKCSNDICLTVHNSTTWHSDYKVKGLCDSNLISMDITFFSEDGELSSLGKAGTG FRSNYFAYETGDKACKMQYCKHWGVRLPSGVWFEMADKDLFAAAKFPECPEGSSI SAPSQTSVDVSLIQDVERILDYSLCQETWSKIRAGLPISPVDLSYLAPKNPGTGP AFTIINGTLKYFETRYIRVDIAAPILSRMVGMISGTNTERELWEDWAPYEDVEIG PNGVLRTSSGYKFPLYMIGHGMLDSDLHLSSKVQVFEHPHIQDAASQLPDDETLF FGDTGLSKNPIELVEGWFSGWKSSIASFFFIIGLIIGLFLVLRVGIYLCIKLKHT RKRKIYADIEMNRLGK | 35139 |
| EEEV | MSLATVMCVLANITFPCDQPPCMPCCYEKNPHETLTMLEQNYDSRAYDQLLDAAV KCNARRTRRDLDTHFTQYKLARPYIADCPNCGHSRCDSPIAIEEVRGDAHAGVIR IQTSAMFGLKTDGVDLAYMSFMNGKTQKSIKIDNLHVRTSAPCSLVSHHGYYILA QCPPGDTVTVGFHDGPNRHTCTVAHKVEFRPVGREKYRHPPEHGVELPCNRYTHK RADQGHYVEMHQPGLVADHSLLSIHSAKVKITVPSGAQVKYYCKCPDVREGITSS DHTTTCTDVKQCRAYLIDNKKWVYNSGRLPRGEGDTFKGKLHVPFVPVKAKCIAT LAPEPLVEHKHRTLILHLHPDHPTLLTTRSLGSDANPTRQWIERPTTVNFTVTGE GLEYTWGNHPPKRVWAQESGEGNPHGWPHEVVVYYYNRYPLTTIIGLCTCVAIIM VSCVTSVWLLCRTRNLCITPYKLAPNAQVPILLALLCCIKPTRADDTLQVLNYLW NNNQNFFWMQTLIPLAALIVCMRMLRCLFCCGPAFLLVCGALGAAAYEHTAVMPN KVGIPYKALVERPGYAPVHLQIQLVNTRIIPSTNLEYITCKYKTKVPSPVVKCCG ATQCTSKPHPDYQCQVFTGVYPFMWGGAYCFCDTENTQMSEAYVERSEECSIDHA KAYKVHTGTVQAMVNITYGSVSWRSADVYVNGETPAKIGDAKLIIGPLSSAWSPF DNKVVVYGHEVYNYDFPEYSTGKAGSFGDLQSRTSTSNDLYANTNLKLQRPQAGI VHTPFTQAPSGFERWKRDKGAPLNDVAPFGCSIALEPLRAENCAVGSIPISIDIP DAAFTRISETPTVSDLECKITECTYASDFGGIATVAYKSSKAGNCPIHSPSGVAV IKENDVTLAESGSFTFHFSTANIHPAFKLQVCTSAVTCKGDCKPPKDHIVDYPAQ HTESFTSAISATAWSWLKVLVGGTSAFIVLGLIATAVVALVLFFHRH- | 35140 |
| VEEV | MSLVTTMCLLANVTFPCAEPPICYDRKPAETLAMLSVNVDNPGYDELLEAAVKCP GRKRRSTKELFKEYKLTRPYMARCIRCAVGSCHSPIAIEAVKSDGHDGYVRLQTS SQYGLDSSGNLKGRTMRYDMHGTIEEIPLHQVSLHTSRPCHIVDGHGYFLLARCP AGDSITMEFKKGSVTHSCSVPYEVKFNPVGRELYTHPPEHGAEQACQVYAHDAQN RGAYVEMHLPGSEVDSSLISLSGSSVTVTPPVGTSALVECKCGGTKISETINKAK QFSQCTKKEQCRAYRLQNDKWVYNSDKLPKAAGATLKGKLHVPFLLADGKCTVPL APEPMITFGFRSVSLKLHPKNPTYLTTRQLADEPHYTHELISEPAVRNFTVTEKG WEFVWGNHPPKRFWAQETAPGNPHGLPHEVITHYYHRYPMSTILGLSICAAIVTV SVAASTWLFCKSRVSCLTPYRLTPNARMPLCLAVLCCARTARAETTWESLDHLWN NNQQMFWIQLLIPLAALIVVTRLLKCVCCVVPFLVVAGAAGAGAYEHATTMPSQA GISYNTIVNRAGYAPLPISITPTKIKLIPTVNLEYVTCHYKTGMDSPAIKCCGSQ ECTPTNRPDEQCKVFTGVYPFMWGGAYCFCDTENTQVSKAYVMKSDDCLADHAEA YKAHTASVQAFLNITVGEHSIVTTVYVNGETPVNFNGVKLTAGPLSTAWTPFDRK IVQYAGEIYNYDFPEYGAGQPGAFGDIQSRTVSSSDLYANTNLVLQRPKAGAIHV PYTQAPSGFEQWKKDKAPSLKFTAPFGCEIYTNPIRAENCAVGSIPLAFDIPDAL FTRVSETPTLSAAECTLNECVYSSDFGGIATVKYSASKSGKCAVHVPSGTATLKE AAVELTEQGSATIHFSTANIHPEFRLQICTSYVTCKGDCHPPKDHIVTHPQYHAQ TFTAAVSKTAWTWLTSLLGGSAVIIIIGLVLATIVAMYVLTNQKHN | 35141 |
| WEEV | MSLVTALCVLSNVTFPCDKPPVCYSLAPERTLDVLEENVNNPNYDTLLENVLKCP SRRPKRSITDDFTLTSPYLGFCPYCRHSAPCFSPIKIENVWDESDDGSIRIQVSA QFGYDQAGTADVTKFRYMSYDHDHDIKEDSVKKIAISTSGPCRRLGHKGYFLLAQ CPPGDSVTVSITSGASENSCTVEKKIRRKFVGREEYLFPPVHGKLVKCHVYDHLK ETSAGYITMHRPGPHAYKSYLEEASGEVYIKPPSGKNVTYECKCGDYSTGIVSTR TKMNGCTKAKQCIAYKSDQTKWVYNSPDLIRHTDHSVQGKLHIPFRLTPTFCPVP LAHTPTVTKWFKGITLHLTATRPTLLTTRKLGLRADATAEWITGTTSRNFSVGRE GLEYVWGNHEPVRVWAQESAPGDPHGWPHEIIIHYYHRHPVYTVIVLCGVALAIL VGIASSAACIAKARRDCLTPYALAPNATVPTALAVLCCIRPTNAETFGETLNHLW FNNQPFLWAQLCIPLAALIILFRCFSSCCMPFLLVAGVCLGKVDAFEHATTVPNVP GIPYKALVERAGYAPLNEITVVSSELTPSTNKEYVTCKFHTVIPSPQVKCCGSL ECKASSKADYTCRVFGGVYPFMWGGAQCFCDSENTQLSEAYVEFAPDCTIDHAVA LKVHTAALKVGLRIVYGNTTAHDTFVNGVTPGSSRDLKVIAGPISAAFSPFDHK VVIRKGLVYNYDFPEYGAMKPGAFGDIQASSLDATDIVARTDIRLLKPSVKNIHV | 35142 |

TABLE 97-continued

Description of glycoproteins tested

| Glyco-protein | Amino acid sequence of glycoprotein (N-C terminus) | SEQ ID NO |
|---|---|---|
| | PYTQAVSGYEMWKNNSGRPLQETAPFGCKIEVEPLRASNCAYGHIPISIDIPDAA FVRSSESPTILEVSCTVADCIYSADFGGSLTLQYKADREGHCPVHSHSTTAVLKE ATTHVTATGSITLHFSTSSPQANFIVSLCGKKTTCNAECKPPADHIIGEPHKVDQ EFQAAVSKTSWNWLLALFGGASSLIAVGLIVLVCSSMLINTRR | |
| Semliki | MSAPLITAMCVLANATFPCFQPPCVPCCYENNAEATLRMLEDNVDRPGYYDLLQA ALTCRNGTRHRRSVSQHFNVYKATRPYIAYCADCGAGHSCHSPVAIEAVRSEATD GMLKIQFSAQIGIDKSDNHDYTKIRYADGHAIENAVRSSLKVATSGDCFVHGTMG HFILAKCPPGEFLQVSIQDTRNAVRACRIQYHHDPQPVGREKFTIRPHYGKEIPC TTYQQTTAETVEEIDMHMPPDTPDRTLLSQQSGNVKITVGGKKVKYNCTCGTGNV GTTNSDMTINTCLIEQCHVSVTDHKKWQFNSPFVPRADEPARKGKVHIPFPLDNI TCRVPMAREPTVIHGKREVTLHLHPDHPTLFSYRTLGEDPQYHEEWVTAAVERTI PVPVDGMEYHWGNNDPVRLWSQLTTEGKPHGWPHQIVQYYYGLYPAATVSAVVGM SLLALISIFASCYMLVAARSKCLTPYALTPGAAVPWTLGILCCAPRAHAASVAET MAYLWDQNQALFWLEFAAPVACILIITYCLRNVLCCCKSLSFLVLLSLGATARAY EHSTVMPNVVGFPYKAHIERPGYSPLTLQMQVVETSLEPTLNLEYITCEYKTVVP SPYVKCCGASECSTKEKPDYQCKVYTGVYPFMWGGAYCFCDSENTQLSEAYVDRS DVCRHDHASAYKAHTASLKAKVRVMYGNVNQTVDVYVNGDHAVTIGGTQFIFGPL SSAWTPFDNKIVVYKDEVFNQDFPPYGSGQPGRFGDIQSRTVESNDLYANTALKL ARPSPGMVHVPYTQTPSGFKYWLKEKGTALNTKAPFGCQIKTNPVRAMNCAVGNI PVSMNLPDSAFTRIVEAPTIIDLTCTVATCTHSSDFGGVLTLTYKTNKNGDCSVH SHSNVATLQEATAKVKTAGKVTLHFSTASASPSFVVSLCSARATCSASCEPPKDH IVPYAASHSNVVFPDMSGTALSWVQKISGGLGAFAIGAILVLVVVTCIGLRR | 35143 |
| Sindbis | MSAAPLVTAMCLLGNVSFPCDRPPTCYTREPSRALDILEENVNHEAYDTLLNAIL RCGSSGRSKRSVIDDFTLTSPYLGTCSYCHHTVPCFSPVKIEQVWDEADDNTIRI QTSAQFGYDQSGAASANKYRYMSLKQDHTVKEGTMDDIKISTSGPCRRLSYKGYF LLAKCPPGDSVTVSIVSSNSATSCTLARKIKPKFVGREKYDLPPVHGKKIPCTVY DRLKETTAGYITMHRPRPHAYTSYLEESSGKVYAKPPSGKNITYECKCGDYKTGT VSTRTEITGCTAIKQCVAYKSDQTKWVFNSPDLIRHDDHTAQGKLHLPFKLIPST CMVPVAHAPNVIHGFKHISLQLDTDHLTLLTTRRLGANPEPTTEWIVGKTVRNFT VDRDGLEYIWGNHEPVRVYAQESAPGDPHGWPHEIVQHYYRHPVYTILAVASAT VAMMIGVTVAVLCACKARRECLTPYALAPNAVIPTSLALLCCVRSANAETFTETM SYLWSNSQPFFWVQLCIPLAAFIVLMRCCSCCLPFLVVAGAYLAKVDAYEHATTV PNVPQIPYKALVERAGYAPLNLEITVMSSEVLPSTNQEYITCKFTTVVPSPKIKC CGSLECQPAAHADYTCKVFGGVYPFMWGGAQCFCDSENSQMSEAYVELSADCASD HAQAIKVHTAAMKVGLRIVYGNTTSFLDVYVNGVTPGTSKDLKVIAGPISASFTP FDHKVVIHRGLVYNYDFPEYGAMKPGAFGDIQATSLTSKDLIASTDIRLLKPSAK NVHVPYTQASSGFEMWKNNSGRPLQETAPFGCKIAVNPLRAVDCSYGNIPISIDI PNAAFIRTSDAPLVSTVKCEVSECTYSADFGGMATLQYVSDREGQCPVHSHSSTA TLQESTVHVLEKGAVTVHFSTASPQANFIVSLCGKKTTCNAECKPPADHIVSTPH KNDQEFQAAISKTSWSWLFALFGGASSLLIIGLMIFACSMMLTSTRR- | 35144 |
| Chikungunya | MCLLANTTFPCSQPPCTPCCYEKEPEETLRMLEDNVMRPGYYQLLQASLTCSPHR QRRSTKDNFNVYKATRPYLAHCPDCGEGHSCHSPVALERIRNEATDGTLKIQVSL QIGIKTDDSHDWTKLRYMDNHMPADAERAGLFVRTSAPCTITGTMGHFILARCPK GETLTVGFTDSRKISHSCTHPFHHDPPVIGREKFHSRPQHGKELPCSTYVQSTAA TTEEIEVHMPPDTPDRTLMSQQSGNVKITVNGQTVRYKCNCGGSNEGLTTTDKVI NNCKVDQCHAAVTNHKKWQYNSPLVPRNAELGDRKGKIHIPFPLANVTCRVPKAR NPTVTYGKNQVIMLLYPDHPTLLSYRNMGEEPNYQEEWVMHKKEVVLTVPTEGLE VTWGNNEPYKYWPQLSTNGTAHGHPEIILYYYELYPTMTVVVVSVATFILLSMV GMAAGMCMCARRRCITPYELTPGATVPPFLLSLICCIRTAKAATYQEAAIYLWNEQ QPLFWLQALIPLAALIVLCNCLRLLPCCCKTLAFLAVMSVGAHTVSAYEHVTVIP NTVGVPYKTLVNRPGYSPMVLEMELLSVTLEPTLSLDYITCEYKTVIPSPYVKCC GTAECKDKNLPDYSCKVFTGVYPFMWGGAYCFCDAENTQLSEAHVEKSESCKTEF ASAYRAHTASASAKLRVLYQGNNITVTAYANGDHAVTVKDAKFIVGPMSSAWTPF DNKIVVYKGDVYNMDYPPFGAGRPGQFGDIQSRTPESKDVYANTQLVLQRPAVGT VHVPYSQAPSGFKYWLKERGASLQHTAPFGCQIATNPVRAVNCAVGNMPISIDIP EAAFTRVVDAPSLTDMSCEVPACTHSSDFGGVAIIKYAASKKGKCAVHSMTNAVT IREAEIEVEGNSQLQISFSTALASAEFRVQVCSTQVHCAAECHPPKDHIVNYPAS HTTLGVQD1SATAMSWVQKITGGVGLVVAVAALILIVVLCVSFSRH | 35145 |
| BABV | MGFTTKIIFLYNLVLVYAGFDDPRKAIELVQKRYGRPCDCSGGQVSEPPSDRVSQ VTCSGKTAYLMPDQRWKCKSIPKDTSPSGPLQECPCNSYQSSVHSSCYTSYQQCR SGNKTYYTATLLKTQTGGTSDVQVLGSTNKLIQSPCNGIKGQSICWSTTAPIHVS DGGGPLDTTRIKSVQRKLEEIHKALYPELQYHPLAIPKVRDNLMVDAQTLNILNA TYNLLLMSNTSLVDDCWLCLKLGPPTPLAIPNFLLSYVTRSSDNISCLIIPPLLV QPMQFSNSSCLFSPSYNSTEEIDLGHVAFSNCTSITNVTGPICAVNGSVFLCGNN MAYTYLPTNWTGLCVLATLLPDIDIIPGDEPVPIPAIDHFIYRPKRAIQFIPLLA GLGITAAFTTGATGLGVSVTQYTKLSNQLISDVQILSSTIQDLQDQVDSLAEVVL QNRRGLDLLTAEQGGICLALQEKCCFYVNKSGIVRDKIKTLQEELERRRKDLASN PLWTGLQGLLPYLLPFLGPLLTLLLLLTIGPCIFNRLTAFINDKLNIIHAMVLTQ QYQVLRTDEEAQD | 35146 |

TABLE 97-continued

Description of glycoproteins tested

| Glyco-protein | Amino acid sequence of glycoprotein (N-C terminus) | SEQ ID NO |
|---|---|---|
| GALV | MVLLPGSMLLTSSLHHLRHQMSPGSWKRLIILLSCVFGGGGTSLQNKNPHQPMTL TWQVLSQTGDVVWDTKAVQPPWTWWPTLKPDICALAAGLESWDIPGTDVSSSKRV RPPDSDYTAAYKQITWGAIGCSYPRARTRMASSTFYVCPRDGRTPSEARRCGGLE SLYCKEWNCETTGTGYWLPKSSKDLITGRWDQNSKWDQKFQKCHQTGWCNPLKID FTDTGKSSRDWIVGKTWGLRFYVHGHPGVQFTIRLKITSMTAVAVGPDPVLVEQG PPRRALALPPPLPPREAPPPPLPDSNSTTLATSAQTPTVGKTIVTLNTPPPTTGD RLFNLVQGAFLTLNATNPGATKSCWLCLAMGPPYYEAITSLGEVAYSTSQDRCHW GTQGKLTLTEVSGHGLCIGKVPFTHQHLCNQTLSINSSEGHQYLLPSNHSWWACS TGLTPCLSTSVFNQSRDFCIQVQLIPRIYYYPEEVLLQAYDDSHPRPKREAVSLT LAVLLGLGITAGIGTGSTALIKGPIDLQQGLTSLQIAIDADLRALQDSVSKLEDS LTSLSEVVLQNRRGLDLLFLKEGGLCAALKEECCFYIDHSGAVRDSMKKLKEKLD KRQLERQKNQWYEGWFNNSPWFTTLLSTIAGPLLLLLLLLILGPCIINKLVQFI NDRVSAVKILVLRTKYQALDNEDN | 35147 |
| RD114 | MKLPTGMVILCSLIIVRAGFDDPRKAIALVQKQHGKPCECSGGQVSEAPPNSIQQ VTCPGKTAYLMTNQKWKCRVTPKNLTPSGGELQNCPCNTFQDSMHSSCYTEYRQC RANNKTYYTATLLKIRSGSLNEVQILQNPNQLLQSPCRGSINQPVCWSATAPIHI SDGGGPLDTKRVWTVQKRLEQIHKAMHPELQYHPLALPKVRDDLSLDARTFDILN TTFRLLQMSNFSLAQDCWLCLKLGTPTPLAIPTPSLTYSLADSLANASCQIIPPL LVQPMQFSNSSCLSSPFINDTEQIDLGAVTFTNCTSVANVSSPLCALNGSVFLCG NNMAYTYLPQNWTGLCVQASLLPDIDIIPGDEPVPIPAIDHYIHRPKRAVQFIPL LAGLGITAAFTTGATGLGVSVTQYTKLSHQLISDVQVLSGTIQDLQDQVDSLAEV VLQNRRGLDLLTAEQGGICLALQEKCCFYANKSGIVRNKIRTLQEELQKRRESLA SNPLWTGLQGFLPYLLPLLGPLLTLLLILTIGPCVFSRLMAFINDRLNVVHAMVL AQQYQALKAEEEAQD | 35148 |
| HTLV1 | MGKFLATLILFFQFCPLIFGDYSPSCCTLTIGVSSYHSKPCNPAQPVCSWTLDLL ALSADQALQPPCPNLVSYSSYHATYSLYLFPHWTKKPNRNGGGYYSASYSDPCSL KCPYLGCQSWTCPYTGAVSSPYWKFQHDVNFTQEVSRLNINLHFSKCGFPFSLLV DAPGYDPIWFLNTEPSQLPPTAPPLLPHSNLDHILEPSIPWKSKLLTLVQLTLQS TNYTCIVCIDRASLSTWHVLYSPNVSVPSSSSTPLLYPSLALPAPHLTLPFNWTH CFDPQIQAIVSSPCHNSLILPPFSLSPVPTLGSRSRRAVPVAVWLVSALAMGAGV AGGITGSMSLASGKSLLHEVDKDISQLTQAIVKNHKNLLKIAQYAAQNRRGLDLL FWEQGGLCKALQEQCRFPNITNSHVPILQERPPLENRVLTGWGLNWDLGLSQWAR EALQTGITLVALLLLVILAGPCILRQLRHLPSRVRYPHYSLIKPESSL | 35149 |
| Rabies | MVPQALLFVPLLVFPLCFGKFPIYTIPDKLGPWSPIDIHHLSCPNNLVVEDEGCT NLSGFSYMELKVGYILAIKVNGFTCTGVVTEAETYTNFVGYVTTTFKRKHFRPTP DACRAAYNWKMAGDPRYEESLHNPYPDYRWLRTVKTTKESLVIISPSVADLDPYD RSLHSRVFPSGKCSGVAVSSTYCSTNHDYTIWMPENPRLGMSCDIFTNSRGKRAS KGSETCGFVDERGLYKSLKGACKLKLCGVLGLRLMDGTWVSMQTSNETKWCPPDK LVNLHDFRSDEIEHLVVEELVRKREECLDALESIMTTKSVSFRRLSHLRKLVPGF GKAYTIFNKTLMEADAHYKSVRTWNEILPSKGCLRVGGRCHPVNGVFFNGIILG PDGNVLIPEMQSSLLQQHMELLESSVIPLVHPLADPSTVFKDGDEAEDFVEVHLP DVHNQVSGVDLGLPNWGKYVLLSAGALTALMLIIFLMTCCRRVNRSEPTQHNLRG TGREVSVTPQSGKIISSWESHKSGGETRL | 35150 |
| Mokola | MNIPCFVVILSLATTHSLGEFPLYTIPEKIEKWTPIDMIHLSCPNNLLSEEEGCN AESSFTYFELKSGYLAHQKVPGFTCTGVVNEAETYTNFVGYVTTTFKRKHFRPTV AACRDAYNWKVSGDPRYEESLHTPYPDSSWLRTVTTTKESLLIISPSIVEMDIYG RTLHSPMFPSGVCSNVYPSVPSCETNHDYTLWLPEDPSLSLVCDIFTSSNGKKAM NGSRICGFKDERGFYRSLKGACKLTLCGRPGIRLFDGTWVSFTKPDVHVWCTPNQ LINIHNDRLDEIEHLIVEDIIKKREECLDTLETILMSQSVSFRRLSHFRKLVPGY GKAYTILNGSLMETNVVYYKRVDKWADILPSKGCLKVGQQCMEPVKGVLFNGIIKG PDGQILIPEMQSEQLKQHMDLLKAAVFPLRHPLISREAVFKKDGDADDFVDLHMP DVHKSVSDVDLGLPHWGFWMLIGATIVAFVVLVCLLRVCCKRVRRRSGRATQEI PLSFPSAPVPRAKVVSSWESYKGLPGT | 35151 |
| MeV-G | MGSRIVINREHLMIDRPYVLLAVLFVMFLSLIGLLAIAGIRLHRAAIYTAEIHKS LSTNLDVTNSIEHQVKDVLTPLFKIIGDEVGLRTPQRFTDLVKFISDKIKFLNPD REYDFRDLTWCINPPERIKLDYDQYCADVAAEELMNALVNSTLLETRTTNQFLAV SKGNCSGPTTIRGQFSNMSLSLLDLYLSRGYNVSSIVTMTSQGMYGGTYLVEKPN LSSKGSELPQPSMHRVFEVGVIRNPGLGAPVFHMTNYFEQPVSNDFSNCMVALGE LKLAALCHGEDSITIPYQGSGKGVSFQLVKLGVWKSPTDMQSWVPLSTDDPVIDR LYLSSHRGIIADNQAKWAVPTTRTDDKLRMETCFQQACKGKIQALCENPEWAPLK DNRIPSYGVLSVDLSLAVELKIKIASGFGPLITHGSGMDLYKSNHNNVYWLTIPP MKNLALGVINTLEWIPRFKVSPNLFTVPIKEAGEDCHAPTYLPAEVDGDVKLSSN LVILPGQDLQYVLATYDTSRVEHAVVYYVYSPSRSFSYFYPFRLPIKGVPIELQV ECFTWDQKLWCRHFCVLADSESGGHITHSGMVGMGVSCTVTREDGTNR | 35152 |
| MeV-F | MGLKVNVSAIFMAVLLTQTPTGQIHWGNLSKIGVVGIGSASYKVMTRSSHQSLV IKLMPNITLLNNCTRVEIAEYRRLLRTVLEPIRDALNAMTQNIRPVQSVASSRRH KRFAGVVLAGAALGVATAAQITAGIALHQSMLNSQAIDNLRASLETTNQAIEAIR QAGQEMILAVQGVQDYINNELIPSMNQLSCDLIGQKLGLKLLRYYTEILSLFGPS | 35153 |

TABLE 97-continued

Description of glycoproteins tested

| Glyco-protein | Amino acid sequence of glycoprotein (N-C terminus) | SEQ ID NO |
|---|---|---|
| | LRDPISAEISIQALSYALGGDINKVLEKLGYSGGDLLGILESRGIKARITHVDTE<br>SYFIVLSIAYPTLSEIKGVIVHRLEGVSYNIGSQEWYTTVPKYVATQGYLISNFD<br>ESSCTFMPEGTVCSQNALYPMSPLLQECLRGSTKSCARTLVSGSFGNRFILSQGN<br>LIANCASILCKCYTTGTIINQDPDKILTYIAADHCPVVEVNGVTIQVGSRRYPDA<br>VYLHRIDLGPPISLERLDVGTNLGNAIAKLEDAKELLESSDQILRSMKGLSSTSI<br>VYILIAVCLGGLIGIPALICCCRGRCNKKGE | |
| Nipah-G | MKKINEGLLDSKILSAFNTVIALLGSIVIIVMNIMIIQNYTRSTDNQAVIKDALQ<br>GIQQQIKGLADKIGTEIGPKVSLIDTSSTITIPANIGLLGSKISQSTASINENVN<br>EKCKFTLPPLKIHECNISCPNPLPFREYRPQTEGVSNLVGLPNNICLQKTSNQIL<br>KPKLISYTLPVVGQSGTCITDPLLAMDEGYFAYSHLERIGSCSRGVSKQRIIGVG<br>EVLDRGDEVPSLFMTNVWTPPNPNTVYHCSAVYNNEFYYVLCAVSTVGDPILNST<br>YWSGSLMMTRLAVKPKSNGGGYNQHQLALRSIEKGRYDKVMPYGPSGIKQGDTLY<br>FPAVGFLVRTEFKYNDSNCPITKCQYSKPENCRLSMGIRPNSHYILRSGLLKYNL<br>SDGENPKVVFIEISDQRLSIGSPSKIYDSLGQPVFYQASFSWDTMIKFGDVLTVN<br>PLVVNWRNNTVISRPGQSQCPRFNTCPEICWEGVYNDAFLIDRINWISAGVFLDS<br>NQTAENPVFTVFKDNEILYRAQLASEDTNAQKTITNCFLLKNKIWCISLVEIYDT<br>GDNVIRPKLFAVKIPEQCT | 35154 |
| Nipah-F | MVVILDKRCYCNLLILILMISECSVGILHYEKLSKIGLVKGVTRKYKIKSNPLTK<br>DIVIKMIPNVSNMSQCTGSVMENYKTRLNGILTPIKGALEIYKNNTHDLVGDVRL<br>AGVIMAGVAIGIATAAQITAGVALYEAMKNADNINKLKSSIESTNEAVVKLQETA<br>EKTVYVLTALQDYINTNLVPTIDKISCKQTELSLDLALSKYLSDLLFVFGPNLQD<br>PVSNSMTIQAISQAFGGNYETLLRTLGYATEDFDDLLESDSITGQIIYVDLSSYY<br>IIVRVYFPILTEIQQAYIQELLPVSFNNDNSEWISIVPNFILVRNTLISNIEIGF<br>CLITKRSVICNQDYATPMTNNMRECLTGSTEKCPRELVVSSHVPRFALSNGVLFA<br>NCISVTCQCQTTGRAISQSGEQTLLMIDNTTCPTAVLGNVIISLGKYLGSVNYNS<br>EGIAIGPPVFTDKVDISSQISSMNQSLQQSKDYIKEAQRLLDTVNPSLISMLSMI<br>ILYVLSIASLCIGLITFISFIIVEKKRNT | 35155 |

The XDPs were designed to contain ribonucleoproteins (RNP) of CasX 676 complexed with single guide RNA variant 251 having spacer sequence 12.7 targeted to tdTomato (encoded by CTGCATTCTAGTTGTGGTTT, SEQ ID NO: 1018) or spacer sequence 7.37 targeted to human B2M (described elsewhere). Utilizing methods described in the sections below, the XDPs were produced by transient transfection of LentiX HEK293T cells (Takara Biosciences) with two structural plasmids encoding components of the Gag-pol HIV-1 system, a plasmid encoding a pseudotyping glycoprotein, and a plasmid encoding the guide RNA. For the plasmid encoding the guide RNAs, the pStx42 plasmid was created with a human U6 promoter upstream of the guide RNA cassette A plasmid encoding a glycoprotein for pseudotyping the XDP was also used. All plasmids contained either an ampicillin or kanamycin resistance gene, were generated using standard molecular biology techniques, and were sequenced using Sanger sequencing to ensure correct assembly.

Cell Culture and Transfection

HEK293T Lenti-X cell culture was performed as described in Example 7, above.

Collection and Concentration

XDPs were collected and concentrated as described in Example 8, above.

Resuspension and Transduction

XDPs were transduced into tdTomato neural progenitor cells, Jurkat T cells, human neural progenitor cells, or human astrocytes. tdTomato neural progenitor cells were resuspended and transduced as described in Example 7, above. Human NPCs were grown in DMEM/F12 supplemented with glutamax, HEPES, non-essential amino acids, Pen/Strep, 2-mercaptoethanol, B-27 without vitamin A, and N2. Cells were harvested using StemPro Accutase Cell Dissociation Reagent and seeded on PLF coated 96-well plates. Cells were allowed to grow for 24 hours before being treated for targeting XDPs (having a spacer for tdTomato) starting with neat resuspended virus and proceeding through 10 half-log dilutions. Cells were then centrifuged for 15 minutes at 1000×g. Human NPCs were grown for 96 hours before analysis of B2M editing by flow. The assays were run 2 times for each sample with similar results. Human astrocytes were similarly treated.

Jurkat cells were grown in RPMI supplemented with FBS. 20,000 cells were transduced with the targeting XDPs (having a spacer for tdTomato) starting with neat-resuspended virus and proceeding through 10 half-log dilutions. Cells were then centrifuged for 15 minutes at 1000×g. Jurkat cells were grown for 96 hours before analysis of B2M editing by flow. The assays were run 2 times for each sample with similar results.

tdTomato fluorescence and editing of the B2M locus was measured using flow cytometry. The assays were run 2-3 times for each sample, with similar results.

Results:

VSV-G-mediated cell entry occurs by binding to the low-density lipoprotein receptor (LDL-R), which is a ubiquitous receptor found on most cell types. Accordingly, the tropism of XDPs pseudotyped with VSV-G is broad. In order to alter the tropism of XDPs relative to XDPs pseudotyped with VSV-G, XDPs were generated with diverse viral glycoproteins as targeting moieties.

A comparison of the mouse and human NPC editing data revealed that the XDPs did not edit mouse and human NPCs at the same levels. Specifically, almost all of the XDPs with vesiculoviral glycoproteins showed a higher level of editing in mouse NPCs (FIG. 125) than they did in human NPCs (FIG. 126). XDPs with Alpharetroviral glycoproteins showed a higher level of editing in human NPCs than in mouse NPCs. Interestingly, XDPs with rabies glycoprotein showed a higher level of editing in mouse NPCs than in human NPCs. Conversely, XDPs with Mokola glycoprotein showed a higher level of editing in human NPCs than in mouse NPCs.

Additionally, XDPs with certain glycoproteins belonging to the vesiculoviral family (including PERV, YBV, JURV, PIRYV, RADV and CHIPV) showed higher levels of editing in human astrocytes (FIG. 127) than in human NPCs (FIG. 126). This finding may be particularly useful to skew XDP tropism towards glial cells rather than neurons, which would be beneficial for glial cell targets.

Finally, the level of editing of the B2M locus was measured in Jurkat cells, a human T lymphocyte cell line. Only XDPs with certain glycoproteins belonging to the vesiculoviral family showed high levels of editing in Jurkat cells (FIG. 128), with minimal editing in Jurkat cells exhibited by XDPs with glycoproteins belonging to lyssaviruses, alphaviruses, paramyxoviruses and retroviruses.

The results of the experiments support that viral glycoproteins can be selectively utilized to preferentially confer tropism on cells intended for gene editing.

Example 36: Guide RNA Guide Scaffold Platform Evolution

Experiments were conducted to identify guide RNA guide scaffold variants that exhibit improved activity for double-stranded DNA (dsDNA) cleavage. In order to accomplish this, a large-scale library of scaffold variants was designed and tested in a pooled manner for functional knockout of a reporter gene in human cells. Scaffold variants leading to improved knockout were determined by sequencing the functional elements within the pool and subsequent computational analysis.

Materials and Methods
Library Design
Assessment of RNA Secondary Structure Stability RNAfold (v2.4.14) (Lorenz R, et al. ViennaRNA Package 2.0. Algorithms Mol Biol. 6:26 (2011)) was used to predict the secondary structure stability of RNA sequences, similar to what was done in Jarmoskaite I., et al. "A quantitative and predictive model for RNA binding by human pumilio proteins", Mol Cell. 74(5):966 (2019). To assess the $\Delta\Delta G\_BC$ value, the ensemble free energy ($\Delta G$) of the unconstrained ensemble was calculated, then the ensemble free energy ($\Delta G$) of the constrained ensemble was calculated. The $\Delta\Delta G\_BC$ is the difference between the constrained and unconstrained $\Delta G$ values. A constraint string was used that reflects the base-pairing of the pseudoknot stem, scaffold stem, and extended stem, and requires the bases of the triplex to be unpaired.

Calculation of Pseudoknot Stem Secondary Structure Stability

Pseudoknot structure stability was calculated for the entire stem-loop spanning positions 3-33, using the triplex loop sequence from guide scaffold 175. Further, a constraint string was generated that enforced pairing of the pseudoknot bases and unpairing of the bases in the triplex loop. Changes in stability could thus only be due to the differences in the sequence of the pseudoknot stem. For example, the pseudoknot sequence AAAACG_CGUUUU was turned into a stem-loop sequence by inserting the triplex loop sequence CUUUAUCUCAUUACUUUGA (SEQ ID NO: 35156), so that the final sequence would be AAAACGCUUUAUCUCAUUACUUUGACGUUUU (SEQ ID NO: 35157), and the constraint string was: '((((((xxxxxxxxxxxxxxxxxxx))))))' (where x=n).

Molecular Biology
Molecular Biology of Library Construction

The designed library of guide RNA scaffold variants was synthesized and obtained from Twist Biosciences, then amplified by PCR with primers specific to the library. These primers amplify additional sequence at the 5' and 3' ends of the library to introduce sequence recognition sites for the restriction enzyme SapI. PCR was performed with Q5 DNA Polymerase (New England Biolabs) and performed according to the manufacturer's instructions. Amplified DNA product was purified with DNA Clean and Concentrator kit (Zymo Research). This PCR amplicon, as well as plasmid pKB4, was then digested with the restriction enzyme SapI (New England Biolabs) and both were independently gel purified by agarose gel electrophoresis followed by gel extraction (Zymo) according to the manufacturer's instructions. Libraries were then ligated using T4 DNA Ligase (New England Biolabs), purified with DNA Clean and Concentrator kit (Zymo), and transformed into MegaX DH10B T1R Electrocomp Cells (ThermoFisher Scientific) all according to the manufacturer's instructions. Transformed libraries were recovered for one hour in SOC media, then grown overnight at 37° C. with shaking in 5 mL of 2xyt media. Plasmid DNA was then miniprepped from the cultures (QIAGEN). Plasmid DNA was then further cloned by digestion with restriction enzyme Esp3I (New England Biolabs), followed by ligation with annealed oligonucleotides possessing complementary single stranded DNA overhangs and the desired spacer sequence for targeting GFP. The oligonucleotides possessed 5' phosphorylation modifications, and were annealed by heating to 95° C. for 1 min, followed by reduction of the temperature by two degrees per minutes until a final temperature of 25° C. was reached. Ligation was performed as a Golden Gate Assembly Reaction. The reaction was cycled 25 times between 37° C. for 3 minutes and 16° C. for 5 minutes. As above, the library was purified, transformed, grown overnight, and miniprepped. The resulting library of plasmids was then used for the production of lentivirus.

Library Screening
LV Production

Lentiviral particles were generated by transfecting LentiX HEK293T cells, seeded 24h prior, at a confluency of 70-90%. Plasmids containing the pooled library were introduced to a second generation lentiviral system containing the packaging and VSV-G envelope plasmids with polyethylenimine, in serum-free media. For particle production, media is changed 12 hours post-transfection, and viruses harvested at 36-48h post-transfection. Viral supernatant filtered using 0.45 µm PES membrane filters and diluted in cell culture media when appropriate, prior to addition to target cells.

72 hours post-filtration, aliquots of lentiviral supernatant were titered by TaqMan qPCR. Viral genomic RNA was isolated using a phenol-chloroform extraction (TRIzol), followed by alcohol precipitation. Quality and quantity of extraction was evaluated by nano-drop reading. Any residual plasmid DNA was then digested with DNase I just prior to cDNA production by ThermoFischer SuperScript IV Reverse Transcriptase. Viral cDNA was subject to serial dilutions through 1:1000 and combined with WPTRE based primers and TaqMan Master Mix prior to qPCR by Bio-Rad CFX96. All sample dilutions are added in duplicate and averaged prior to titer calculations against a known, plasmid-based standard curve. Water is always measured as a negative control.

LV Screening (Transduction, Maintenance, Gating, Sorting, gDNA Isolation)

Target reporter cells are passed 24-48 hours prior to transduction to ensure cellular division occurs. At the point of transduction, the cells were trypsinized, counted, and diluted to appropriate density. Cells were resuspended with no treatment, library- or control-containing neat lentiviral supernatant at a low MOI (0.1-5, by viral genome) to minimize dual lentiviral integrations. The lentiviral-cellular mixtures were seeded at 40-60% confluency prior to incubation at 37° C., 5% $CO_2$. Cells were selected for successful transduction 48h post-transduction with puromycin at 1-3 μg/ml for 4-6 days followed by recovery in HEK or Fb medium.

Post-selection, cells were suspended in 4',6-diamidino-2-phenylindole (DAPI) and phosphate-buffered saline (PBS). Cells were then filtered by Corning strainer-cap FACS tube (Prod. 352235) and sorted on the Sony MA900. Cells were sorted for knockdown of the fluorescent reporter, in addition to gating for single, live cells via standard methods. Sorted cells from the experiment were lysed, and the genome was extracted using a Zymo Quick-DNA Miniprep Plus following the manufacturer's protocol.

Processing for Next Generation Sequencing (NGS)

Genomic DNA was amplified via PCR with primers specific to the guide RNA-encoding DNA, to form a target amplicon. These primers contain additional sequence at the 5' ends to introduce Illumina read and 2 sequences. Amplified DNA product is purified with Ampure XP DNA cleanup kit. A second PCR step was done with indexing adapters to allow multiplexing on the Illumina platform, followed by purification, and quality and quantification assessment. Amplicons were sequenced on the Illumina Miseq according to the manufacturer's instructions.

NGS Analysis (Sample Processing and Data Analysis)

Reads were trimmed for adapter sequences with cutadapt (version 2.1), and the guide sequence (comprising the scaffold sequence and spacer sequence) was extracted for each read (also using cutadapt v 2.1 linked adapters to extract the sequence between the upstream and downstream amplicon sequence). Unique guide RNA sequences were counted, and then each scaffold sequence was compared to the list of designed sequences and to the sequence of guide scaffolds 174 (SEQ ID NO: 2238) and 175 (SEQ ID NO: 2239) to determine the identity of each.

Read counts for each unique guide RNA sequence were normalized for sequencing depth using mean normalization. Enrichment was calculated for each sequence by dividing the normalized read count in each GFP-sample by the normalized read count in the associated naive sample. For both selections (R2 and R4), the GFP- and naive populations were processed for NGS on three separate days, forming an enrichment value for each scaffold in triplicate. An overall enrichment score per scaffold was calculated after summing the read counts for the naive and GFP-samples across triplicates.

Two enrichment scores from different selections were combined by a weighted average of the individual $\log_2$ enrichment scores, weighted by their relative representations within the naive population.

Error on the $\log_2$ enrichment scores was estimated calculating a 95% confidence interval on the average enrichment score across triplicate samples. These errors are propagated when combining the enrichment values for the two separate selections.

Results and Discussion

Library Design, Ordering, and Cloning

A library of guide RNA variants was designed to both test variation to the RNA scaffold in an unbiased manner and in a targeted manner that focused on key modules within the RNA scaffold.

In the unbiased portion of the library, all single nucleotide substitutions, insertions, and deletions were designed to each residue of guide scaffolds 174 (SEQ ID NO: 2238) and 175 (SEQ ID NO: 2239) (~2800 individual sequences). Double mutants were designed to specifically focus on areas that could possibly be interacting; thus if in the CryoEM structure (PDBid: 6NY2), two residues were involved in a canonical or non-canonical base pairing interaction, or two residues were predicted to pair in the lowest-energy structure predicted by RNAfold (v2.4.14), then the corresponding residues in guide scaffolds 174 and 174 were mutated (including all possible substitutions, insertions, and deletions of both residues). Adjacent residues to these 'interacting' residues were also mutated; however for these only substitutions of each of the two residues were included. In the final library, ~27K sequences were designed with two mutations relative to guide scaffolds 174 or 175.

In the portion of the library devoted to specific mutagenesis of key regions of the RNA scaffold, modifications were designed to: the pseudoknot region, the triplex region, the scaffold bubble, and the extended stem (see FIG. 129 for region identification). In each of these targeted sections of the library, the entire domain was mutagenized in a hypothesis-driven manner (FIG. 130). As an example, for the triplex region, each of the base triplets that comprise the triplex was mutagenized to a different triplex-forming motif (see FIG. 131). This type of mutagenesis is distinct from that employed in the scaffold stem bubble, in which all possible substitutions of the bases surrounding the bubble were mutagenized (i.e., with up to 5 mutations relative to guide sequences 174 or 175). In contrast again, the 5 base-pairs comprising the pseudoknot stem were completely replaced with alternate Watson-Crick pairing sequence (up to 10 distinct bases mutagenized).

A final targeted section of the library was meant to optimize for sequences that were more likely to form secondary structures amenable to binding of the protein. In short, the secondary structure stability of a sequence was predicted under two conditions: 1) in the absence of any constraints, 2) constrained such that the key secondary structure elements such as pseudoknot stem, scaffold stem, and extended stem are formed (see Materials and Methods). Our hypothesis was that the difference in stability between these two conditions (called here ΔΔG_BC) would be minimal for sequences that are more amenable to protein binding, and thus we should search for sequences in which this difference is minimal).

The designed library was ordered from Twist (~40K distinct sequences), and synthesized to include golden gate sites for cloning into a lentiviral plasmid backbone that also expressed the protein STX119 (see Materials and Methods). A spacer sequence targeting the GFP gene was cloned into the library vector, effectively creating single-guide RNAs from each RNA scaffold variant to target the GFP gene. The representation of the designed library variants was assessed with next generation sequencing (see Materials and Methods).

Library Screening and Assessment

The plasmid library containing the guide RNA variants and a single CasX protein (version 119) was made into lentiviral particles (see Materials and Methods); particles were titered based on copy number of viral genomes using a qPCR assay (see Materials and Methods). A cell line stably expressing GFP was transduced with the lentiviral particle library at a low multiplicity of infection (MOI) to enforce that each cell integrated at most one library member. The cell pool was selected to retain only cells that had a genomic integration. Finally, the cell population was sorted for GFP expression, and a population of GFP negative cells was obtained. These GFP negative cells contained the library members that effectively targeted the CasX RNP to the GFP protein, causing an indel and subsequent loss of function.

Genomic DNA from the unsorted cell population ("naive") and the GFP negative population was processed to isolate the sequence of the guide RNA library members in each cell. To determine the representation of guide RNAs in the naive and GFP negative populations, next generation sequencing was performed. Enrichment scores were calculated for each library member by dividing the library member's representation in the GFP-population by its representation in the naive population: A high enrichment score indicates a library member that is much more frequent in the active, GFP negative population than in the starting pool, and thus is an active variant capable of effectively generating an indel within the GFP gene (enrichment value >1, $\log_2$ enrichment >0). A low enrichment score indicates a library member that is depleted in the active GFP-population compared to the naive, and thus ineffective at forming an indel (enrichment value <1, $\log_2$ enrichment <0). As a final statistic for comparison, the relative enrichment value was calculated as the enrichment of a library member (in the GFP negative vs naive population), divided by the enrichment of the reference scaffold sequence (in the GFP negative vs naive population). (In log space, these values are simply subtracted.) The enrichment values of the reference scaffold sequences are shown in FIG. 132).

The screen was performed multiple times, with independent production of lentiviral particles, transduction of cells, selection and sorting to obtain naive and GFP negative populations, and sequencing to learn enrichment values of each library member. These screens were called R2 and R4, and largely reproduce the enrichment values obtained for single nucleotide variants on guide scaffolds 174 and 175. The screen was able to identify many possible combinations of mutations that were enriched in the functional GFP-population, and thus can lead to functional RNPs. In contrast, no guides that contained non-targeting spacers were enriched, confirming that enrichment is a selective cutoff (data not shown). The full set of mutations on guide scaffolds 174 and 175 that were enriched are given in Tables 98 and 99, respectively. These lists reveal the sequence diversity still capable of achieving targeted, functional RNPs.

Single Nucleotide Mutations Indicate Mutable Regions of the Scaffold:

To determine scaffold mutations that lead to similar or improved activity relative to guide scaffolds 174 and 175, enrichment values of single nucleotide substitutions, insertions, or deletions were plotted as heat maps (data not shown). Generally, single nucleotide changes on guide scaffold 174 were more tolerated than guide scaffold 175, perhaps reflecting higher activity of guide scaffold 174 in this context and thus a higher tolerance to mutations that dampen activity (FIG. 132 and FIG. 134). Single nucleotide mutations on 175 that were favorable were also favorable in the context of guide scaffold 174 in the vast majority of cases (FIG. 133), and thus the values for mutations on guide scaffold 175 were taken to be a more stringent readout of mutation effects. Key mutable areas were revealed by this analysis, as described in the following paragraphs:

The most notable feature was the extended stem, which showed similar enrichment values as the reference sequences for scaffolds 174 or 175, suggesting that the scaffold could tolerate changes in this region, similar to what has been seen in the past and would be predicted by structural analysis of the CasX RNP in which the extended stem is seen to have little contact with the protein.

The triplex loop was another area that showed high enrichment relative to the reference scaffold, especially when made in guide scaffold 175 (e.g., especially mutations to C15 or C17). Notably, the C17 position in 175 is already mutated to a G in scaffold 174, which is one of the two highly enriched mutations at this position to scaffold 175.

Changes to either member of the predicted pair in the pseudoknot stem between G7 and A29 were both highly enriched relative to the reference, especially in guide scaffold 175. This pair is a noncanonical G:A pairing in both guide scaffolds 174 and 175. The most strongly enriched mutation at these positions were in guide scaffold 175, converting A29 to a C or a T; the first of which would form a canonical Watson-Crick pairing (G7:C29), and the second of which would form a GU wobble pair (G7:U29), both of which may be expected to increase stability of the helix relative to the G:A pair. Converting the G7 to a T was also highly enriched, which would form a canonical pair (U7:A29) at this position. Clearly, these positions favor being more stably paired. In general, the 5' end was mutable, with few changes leading to de-enrichment.

Finally, the insertion of a C at position 54 in guide scaffold 175 was highly enriched, whereas deletion of either the A or the inserted G at the analogous position in guide scaffold 174 both had similar enrichment values as the reference. Taken together, the guide scaffold may prefer having two nucleotides in this scaffold stem bubble, but it may not be a strong preference. These results are further examined in the sections below.

Pseudoknot Stem Stability is Integral to Scaffold Activity

To further explore the effect of the pseudoknot stem on scaffold activity, the pseudoknot stem was modified in the following ways: (1) the base pairs within the stem were shuffled, such that each new pseudoknot has the same composition of base pairs, but in a different order within the stem; (2) the base pairs were completely replaced with random, WC-paired sequence. Two hundred ninety one (291) pseudoknot stems were tested. Analysis of the first set of sequences shows a strong preference for the G-A pair to be in the first position of the pseudoknot stem, relative to the other possible positions (positions 2-6; in the wildtype sequence it is in position 5; FIG. 134), while the results demonstrate that having a GA pair at each of the positions 2-6 in the pseudoknot stem is generally unfavorable, with low average enrichment. Having the G-A bases at position 1 likely stabilizes the pseudoknot stem by allowing the rest of the helix to form from stacking, Watson-Crick pairs only. This result further supports that the scaffold prefers a fully-paired pseudoknot stem.

A substantial number of pseudoknot sequences had positive $\log_2$ enrichment, suggesting that replacing this sequence with alternate base pairs was generally tolerated (pseudoknot structure in FIG. 135). To further test the hypothesis that a more stable helix in the pseudoknot stem would result in a more active scaffold, the secondary structure stability of each pseudoknot stem was calculated (Materials and Methods). A strong relationship was observed between pseudoknot stability and enrichment, and thus activity (FIG. 136:

more active scaffolds have stable pseudoknot stems), with guide scaffolds with stable pseudoknot stems (<−7 kcal/mol) having high enrichment and guide scaffolds with destabilized pseudoknot stems (≥−3 kcal/mol) having very low enrichment.

Double Mutations Indicate Mutable Regions of the Guide Scaffold:

Double mutations to each reference guide scaffold were examined to further identify mutable regions within the scaffold, and potential mutations to improve scaffold activity. Focusing on just a single pair of positions—positions 7 and 29 which are predicted to form a noncanonical G:A pair in the pseudoknot stem and supports mutagenesis (see sections above) —we plot all 64 double mutations for this pair of positions (FIG. 137). Canonical pairs are favored at these two positions (e.g. substitution of a C at position 7 and a G at position 29 creates a G:C pair and is enriched; substitution of a C at position 7 and an insertion of a G at position 29 similarly creates a G:C pair, substitution of an A at position 7 and a U at position 29 creates an A:U pair). No pair of insertions was enriched, perhaps because inserting a canonical pair here is not sufficient to stabilize the helix given that the G:A pair is shifted up a position in the helix and not removed entirely. Surprisingly, several enriched double mutations did not form canonical pairs; e.g. substitutions of U at position 7 and C at position 29 (which forms a noncanonical U:C pair), substitutions of U at position 7 and U at position 29 (forming a U:U pair), as well as a few others (FIG. 137). It is possible that a purine:purine pair is substantially more disruptive to the helix than other noncanonical pairs. Indeed, substitution of an A at position 7 and G at position 29 again forms an A:G pair, which is not enriched at this position.

Enrichment values of double substitutions within each of the key structural elements of guide scaffold 175 were determined from heat maps in which each position could have up to three substitutions. It was determined that the scaffold stem was the least tolerant to mutation, suggesting a tightly constrained sequence in this region.

The results demonstrate substantial changes may be made to the guide scaffold that still result in functional gene knockout when utilized in an editing assay. In particular, the results demonstrate key positions that may be utilized to improve activity through modifications in the guide scaffold, including increased secondary structure stability of the pseudoknot stem within the scaffold.

TABLE 98

Guide 174 mutations and resulting relative enrichment

| Log$_2$ enrichment | Mutations on gRNA scaffold 174* (SEQ ID NO: 2238) |
|---|---|
| 3.25 to 3.5 | G79A, A80G; T34A, G78T; G7T, G75A; G78A, A80T; ˆC2, A33T; ˆA1, C68T; TG3CT, CGC6TAG, GAG28CTA, CA32AG; TG3CA, GC7AA, GA28TT, CA32TG; ˆC4, C6G, T12_, G17C, GAG28CCC, C32G, A80C; T9C, T14A, T71A, C73A; C70A, G77T |
| 3.0 to 3.25 | A29T, G78T; T9C, G17C, A27T, G79_; C2G, A21G; ˆA81, ˆC81; T71A, C73A; T14C, T16G; ˜T64, ˆG81; T9C, G17C, ˜TG65; C2G, T16A; G7C, TC14AT, G17A, T34A; G75A, G77A; G7C, A21T; T-.3.CA, GC.7.-T, G28_, -A.33.TG, ˜T84; T65C, C82T; GCTCCC63_, ˆAATGAAAA70, ˜TTTTCATT76, GGGAGC77_; ˆC2, G7A, A27T; T9C, G17C, C67G; ˆA78, ˜T78; T3C, GCG5AGA, AGC29GCT, A33G; T9C, G17C, G78C; T3C, GC5TG, AGC29CAA, A33G; T9A, ˜T68, G77A; G7A, T9G; T65A, ˆG77; ˆG70, ˆC75; C2T, G79C; ˆC66, G78A; A29C, G75A; C15A, A60G; C67G, ˆA78; T14C, G17T, G40A, A76G; T34A, CT64TC; ˆA69, T69A; T45G, G79T; T69C, ˆC76; C2A, G54C; A13C, C15A, G74C; C70G, ˆA75; A76G, G77C; C67T, G78C; TG3CC, A29C, CA32GG; ˜T7, A29C; C2A, T34A; ˆA66, ˆA66; C66T, A80C; ˆG17; ˆC76, ˆA76; A29C; C15G, C67G, T72G; ˜T70, ˆA70; C15G, T16G; C64T, C66A; T69G, G74C; ˆA3, G74C; ˜T65, ˜T80 |
| 2.9 to 3.0 | A29C, A33T; C64T, G78A; ˆC64, A80T; ˆA74; T65A, ˆA80; ˜T69, G75T; ˆC79, ˆA79; A29G, T59A; T69G, G75C, G78A; ˆG70, ˆA70; G7A, TC14CG, G17A, C64T; ˜T69, ˆA76; T9C, G17C, C68T, T72C; ˜T69, A76G; A33T, C66G; C66T, C67G; TTC71ACA, ˆGGATGT75; A13G, T14A; T69A, G74C; G74T, A76G; G77C, G78A; A27C, T84G; C2_, C66G; T71C, G75C; TC14AG, G78A; T3G, A33T; T9C, G28A; ˆA1, C2T; C68T, T72C; TGGC3CCAG, C8A, GA26_, -A.33.TGG; C64T, C66G; ˆA67, C67G; C68T, G74A, G77C; G7T; C2T, G78T; C68_, G77T; T25C, A29C; ˆA78, G78A; ˆC78, G78C; G7C, A60G; T34A, T45A; T3_, G7A, ˆA9, ˜T28, A29G, A33_; ˆCAG70, T72G, G-.74.AGT; A27G, A29C; T9C, G17C, T47C; ˜T19; ˆA65, ˜T65; C67G, C68T |
| 2.8 to 2.9 | T3C, G5T, C8G, GA28CC, CCA31AAG; T69C, A76G; C66T, A80T; ˆG13; C2_, T65G; G7C, T9G; T9C, G17C, TT71AC; C6G, A29T; ˆC66, ˆC79; C70A, A76T; T3A, CG6AC, AG29GT, A33G; ˜T7, T12_; ˜T69, ˆA76, A88C; C35G, G58C; ˆA79, ˜T79; T16_, C67T, G79_; G7T, T9A; A29T, C37T, C66G, ˆG77; C2_, G81A; C15G, T34G; T3_, ˜T9, ˆC28, A29C, C32_; ˜T76, ˆA76; G7C, A27T; C2_, G79C; TGGC3ACAG, GA26_, -A.33.TGT; ˆG65, ˆG77; ˆAC1, GC5_, C8T, GA26_, G30A, ˆGT34; T9C, G17C, C66T, A80T; T71G, T72G; G4C, CT8GC, G17C, GA28AC, C32G, T69C, G75C; C41A, G51T; ˜T78; T9C, G17C, T65A, A80C; AG29CA, C82G; T9G, C82T; T45A, T47C; C2T, T3A; T65A, A80G; C2G, G4A, C32T; G7C, T59G; T9C, T14G; C2G, A29C, T52A; T9C, G17C, -A.53.CC; T9C, T69_, A76_; C68A, G75C; A1G, A33T; T3_, ˜T9, G28_, ˆG32; ˆG70, G75C; ˆC54, G54C; ˜T79, G79A; G17C, C70T, A76G; G77A; ˜T69, A76C; T65A, ˆC80; ˆA66, G79_; T9G, ˆG85; ˜TGGAAGAT63, C-.66.TCGG, C68A, GGAGGGAG74_, ˆA83; ˜T2; G7A, A29C; ˆA69, ˆC76; C6A, A29C; C2_, T9C, G17C, GA79TG |

TABLE 98-continued

Guide 174 mutations and resulting relative enrichment

Log$_2$ enrichment | Mutations on gRNA scaffold 174* (SEQ ID NO: 2238)
---|---
2.7 to 2.8 | T34A, ˜T37; A36T, T65C; C2_, T69G; C73A, G74C; G17_; ˆG65, ˆA65; ˜T67, C67T; C2G, A29T; T9C, G17C, ˜C66, ˆG74; C70A, T71C; T14A, C15T; G4C, C32G, G78C; T9C, G17C, T34A; ˆA66, ˆC79; AGT53GTG; G79_; T9G, T14A; ˆC64, ˆC80; T65C, ˆG66; ˆGT1, G7A, T9C; A60T, G78T; T9C, G17C, C67A, G79A; TC65CG, A80G; T14C, T16C; T3_; ˆCGAAC70, T71A, G74C; G7T, C8G; T3A, GC7CG, GA28CG, A33T; C66T, G78T; A1G, T9C, G17C; T69C, C70A; C70T, T72G; T69C, T71G, A80T; T16G, A29C; T11G, A29C; G17A, ˜TA75, A88C; G7T, G40A, A61G; ˆAC81, A88C; ˆA71; G5C, C8G, GA28AC, C31G, C73T; G74T, A76C; ˜T68, ˆA76; C2_, C70A; T9C, G28T; G28T, A29C; ˆC29; A29C, GA75AC; ˜T52, G54C; G7A, T9C, G17C; T9C, G17C, G79A; -A.29.CAC; ˆA68, G77A; ˜T69; G7C, T9C; A80C, C82T; ˆC75, G75T; T14A, A29C; T72C, C73A; T9C, G17C, C66A, G79_; C2_, A33T; ˜T2, C64T; ˆAT79, A88C; C66G, A80C; ˆA67, ˜T78; ˆG67, G78A; ˆA76; A21G, ˆC66, ˜T77; C2A, A36G, T69A; G63T, T71C; T9C, G17C, -G.77.CT; ˜T2, T34A; C68T, ˆC77; T9C, G17C, T72C; T69A, C70T; CT15TA, A18T; TGG3ACA, C8G, GA28CC, CCA31TGT; T9C, A29C; C6G, G30C; -T.3.AA, C67G; C73_; ˆG68, ˆA76; T69C, ˆA76; A80G; T69C, A76_; ˆG68, ˜T77
2.6 to 2.7 | T9A, A29C; A76G; T9C, G17C, AG76CC; T9C, ˆA13; ˆA67, ˜T78, A88C; C70A, T72C; C66G, ˜T79; ˜T64, C64T; ˆA70, C70G; ˆG65, A80C; T9C, G17C, C66T, G78C; C2_, T9G; T69_, A76T; T3A, G7A, A29T, A33G; T45G, C68A; ˜T65, ˜T80, A88C; C66G; C64T, T71G; C2G, G54T; A1G, T3A; ˆG70, G75T; T65A, ˜T80; -T.3.AC, GC.7.A-, GAG28TGC, CA32GG, T72A, ˆG74, A76G; A21C; T69G, ˆA76; C68G, C70A; C67T, A80T; ˆA70, ˆC75; T9A, T14C; T3A, CGC6TCT, GAG28AGA, A33T; G54_; C68T; ˜T65, G79C; C2_; C67G, G79T; CT2TG, G7A, G77C; T71G, G74A; C66T, G81A; A29T; -A.29.CAT, A88C; T69_, ˆC76; T9C, G17C, ˆG68; ˆA69, T69C; A29C, G30T; T69_; G17C; ˆA67, G78C; T65A; ˆG79, ˜T79; A76G, G77T; ˆGC1, A88C; A27T, A29C; ˆCA79, A88C; T69_, G75T; C38G, ˆC56, G77A; C68T, G77C; A29C, AG39GT, T52C; G79T, A80T; G7T, A61T; T16C; ˆA13; G7C, C15G; G5C, C8G, GA28AC, C31G; C2_, G77C; A29C, T52A; G75C, A76G; T9C, G17C, ˆC76; C8G, A29C; TGG3GTC, C8G, GA28AC, CCA31GAC; C64_, ˆGTG67, C68A, G77T, ˆCAC79, G81_; ˜T68, G79_; ˆA70, C70A; T65A, AG76GA; ˆC70, ˆC70; C68G, G77T; C6T, A29T; ˜T81; ˆG67, ˆA67; TGG3GCA, C8A, A29C, CCA31TGC; G7A, A27C, A29G, A80G; G78A; T52G, G54C; T9C, G17C, T65A, C67T; A1C, ˆC64, ˜T81; ˜T80, A80C; C67A, C73T; C73T, A80C; C67A, T69C; G7A, A76T, A80C; C2_, C15G; T69C, G77T; CT2_, G79T; G7C, ˆG28; ˆC79; ˆA80; ˆG1, ˆC1; ˆG65, A80T; G7T, A29_; -T.3.AC, GC.7.A-, GAG28TGC, CA32GG, T65A; T9C, ˜T14, G17C, ˆC29; A29T, T69C; T9C, A29G; C64T, T65C; ˜TG70, T71A, C73_, G75T; T65G, C66T; T59C, ˆC66; T72A, G74A; C2T, T72C; T71C, A76G; T65G, A80T; TG3_, ˜TG7, GA26_, ˆAG33
2.5 to 2.6 | T9C, G17C, ˆG81; -A.29.CAT; C68T, A76G; A29C, G79A; G17C, C67G, C70T; ˆG66, C66G; A29T, G63A, C66A; G28C, A29C; T3G, C67A; T69C, T71C; T3A, GC7CA, GA28TG, A33G; C70G, G74A; ˆC2, G4C, C8_, ˆCGC28, CCA31_ C2_, C68T; C66A, A80T; T3A, G5C, GC7AA, GA28TT, C31G, A33T; T9C, G17C, T72G; T9C, G17C, A29C; ˆC70, G75T; C66T; C66T, G78A; A36T, G54C, C68T; ˆG9, A29T; A76C; T69C, G77C; ˆA77, ˆG77; T71G, G74C; C67T; C73G; T71G, AG76GA; ˆC64, T65C; T3G, C68A; G74C; C67T, T69A; ˆA69; ˆA66, C66T; T71C; T14G, T16C; T9C, G79T; T65C; ˆC15, G17C; ˜T65, ˆC79; C70G, T71G; G74C, G75T; C2_, C68G; G7T, A27G; ˆCA76, A88C; ˜T65, ˆA65; T9C, G17C, T45A; A18C, ˆA66; A80C; G7C, TC14CT, G17A; TG3GC, G7A, A29T, CA32GC; T16G, A29C, G63T, T71C; C2A, G54T, T71C; ˜T8, A29C; T9C, TG16GC; C70T, G77T; G75T, A76G; T69A; T16A, A18G; G77A, G78C; A1_, T59C; T14G, T16G; ˆA60, G81A; A29G, A83G; T34A, GA79TC; T69C, G75A; G7T, T59A; G7T, C82G; A36T, G81T; C2_, G81T; T14C, T72_; -A.29.CAC, A88C; TGG3_, ˆAAG9, GA28CT, C31G, A33G; G17C, A18G; C66G, G77A; ˆC5, C6T, C8_, G28C, GC30CG; C82T; G54A, ˆG56; C2_, C66T; G17C, A18C; G17C, G54_; G28A, T65C; C6T, A29C; G7A, T9C, ˜T79; T9C, GA17CT; G74A, G75T; C68A, C70G; G42C, C50G; ˆC70, ˆC75; ˜T66, ˆC66; T3C, CGC6GCT, G28_, ˆA32, A33G; C73A, G74A; TG3AC, C6A, AG29CT, CA32GG; C67A, G79A; A76_; C73G, G74T; TG3CA, GC7AG, GA28CG, CA32TG; T9C, T14C, T71A, C73A; G81C; A1G, T16A; T69A, ˆG74; C68_; C2A, A60C; T9C, G54T; T14C, C15G; ˆG66, ˆG66; T16C, A18G; ˆG68, G77C; A29T, -G.78.CC; G7T, ˜T61; CT2_, T72G; A1G; T65C, C66A; G7C, T34A; ˆC35, T59G; ˆAG77, A88C; ˜TG67, A88C;
2.4 to 2.5 | G54C, T59A; T69G, G75C; C68A, A76G; ˆAT65, A88C; C68T, G77T; G7T, A29C; T65A, T71A, G74A; T16A; ˆC65, ˆA65; ˜T67, G79_; ˆG71; ˆC18; ˆC29, A29T; G79A; T69G, T71A; T71C, T72C; C2_, T3_; ˜T67, G78T; CTCCCTCT64_, C73G, AGG76TTC, ˜TCCCA82; T65A, A83G; C70A, G74A; G7C, TC14AT, G17A, T34C; G7T, A33C, A36C, A76G; T-.3.CA, GC.7.A-, AG29GC, CA32TG; C2_, A80G; -T.3.AC, C6T, C8_, G28C, G30C, CA32GT; G7C, A83G; C2_, C67A; T3G, A29C, T34G, G77A; C2G, A21G, T65C; G40A, T59A; ˆA66, ˆG66; G81A; C2_, A29G; ˜T64, G81A; ˆCGC2, CGC6_, GAG28_, ˆAGG33; ˆC77; T69A, A76G;

TABLE 98-continued

Guide 174 mutations and resulting relative enrichment

| Log₂ enrichment | Mutations on gRNA scaffold 174* (SEQ ID NO: 2238) |
|---|---|
| | ˜T78, ˆT78; C66A, ˆC79; C2_, G7A, T34A; T3C, C6T, G30A, A33G, ˆC55; GC7CG, GA28AG; T3C, G5C, GC7TA, G28T, C31G, A33G; ˜T68, ˆC77; ˜T77, G77A; A27G, ˆGT77; ˆG66, ˜T79, A88C; T9C, ˆG69, ˆA76; C68T, G75C; ˜T81, ˆT81; ˆC66; T9C, G28C; T14A, A29C, C66T; ˆA65; T3A, G5C, C8A, A29C, C31G, A33T; CT2_, T71A; G7C, C15G, A33T; G77A, ˜T78; G63T, C82A; G7A, C15G, G54A, A60C, G79T; ˆA13, ˆG13; T72G, C73T; A36C, G54T; T3G, G7T; ˆG65, T65C; T65G, C66G; G77C; T45G; C15A; C41T, G51A; T14A; C2T, G54T; A76T; T71A, A76G; ˆG66, ˜T79; ˆA7, A29C; TGG3AAC, C8G, GA28CC, CCA31GTG; ˆA1; ˜T29; T71G, G74T; T45A; ˆAT78, A88C; ˆA3, GG4CC, C8_, GA28CG, CCA31GAT; C66T, C70G; C2_, ˆA66, ˆC79; ˜TA76, A88C; TG3GA, CG6GA, AG29TC, CA32TC; ˆC80, A80G; G79C; C67G, ˆG77; ˆC66, G79A; G7A, T16C, ˜T68; G7C, T9C, G17C, G75C; C2_, ˜T58; ˆA65, ˆC80; A1G, -C.68.GA; G17C, T65G; TG3CC, C6T, C8G, GAG28ACA, CA32GG; T72C, G75A; C64G, A80T; G7A, C66T; C66G, ˆC79; C15A, G17A; ˆAG66, A88C; A36_; G79T; T9C, G17C, ˜T58; T10G, A29T; ˆG69, ˆC76; ˆA69, A76_; G7A, A29G; A53_; T65G, ˆA80; C70A, C73A; T59C, G74T; C67A; G54T, ˆG56; ˆG66; C2_, A29C; C38_, G54_; T3_, C6T, ˆC8, ˆG28, G30A, A33_; -TG.3.ACC, C6A, C8_, ˆCTC28, A29G, CCA31_; T9C, T14A; C64_; T14G, G54A; T71C, C73G, A83C; T9C, G17C; A53G, G54T; C66A, A80G; ˆG63, ˆG81; ˆG1; ˆC78, ˆC78 |
| 2.3 to 2.4 | G7A, T9C; ˜T67, ˆG67; C2_, C67T; A80_; ˆG1, A13C; ˆG66, G79C; T69A, A76T; T9C, T14C; A76G, G78C; T16G, G17T; T69C, G77A; T65_, A80G; G7C, T14C, T34G; C66T, C67T; A53G, -A.80.TC; C67T, G77C; C73A, G74T; A36G, C68G; T9C, G17C, ˆC78; TGG3GCT, C8G, ˆAC28, CA32_; ˜T18; ˆC29, ˜T29; AGGGCG63, C68T, TTCGGA71_, ˆCCGCC82; T9C, G17C, C66T, A80G; ˆA67, ˆG67; C2_, G79T; T3A, CGC6GAT, GAG28ATC, A33T; C2_, A21G, G79C; C2_, A21G; C64T, G77A; C8A, G79C; C67G, ˆA78, A80C; T69C, ˆA70; G74T, G75C; ˜T76, A76G; A76T, A80G; ˆC64; ˆC29, C50T; ˆAGCTTA65 ˆATTG68, T69A, T72C, G77T, GA-.79.AGCT; A29T, G30A; T65C, A80C; ˆC76, ˜T76; T9C; ˆG67, G79_; C68T, G79T; ˆCTCA3, GCGC5_, ˆCAT28, CCA31_; ˆGA70, A88C; -T.3.AC, GC.7.A-, GAG28TGC, CA32GG; A21G; ˆG69, T69C; G7A, ˆC66, ˆG74; ˜T65, ˆA79; T65G; G74A, A76C; G74T, G75A; ˆG68, G77T; T9G, G79T; ˆAG67, A88C; ˆC81; ˆA67, G78T; C37A, G57T; G54C, G79T; G75T, G77A; G40A, TAG52CCT; ˆG15; C67A, C68A; A36T, ˆC55; G46T, T59A, T65C; C67T, ˆG68; T71C, A76C; G7C, A29G, T65A; ˆA78; T69C, G75T; ˜TC66, A88C; CT2_, T59A; T9C, G17C, T65G; C70G, G75T; C2_, C73T, G75A; TG3CC, C6G, C8T, G28A, G30C, CA32GG; C64G, C66T; T11C, A29C; T9C, ˆG15, G17C, T65C; T69G, G74T; ˆGA65, A88C; G7C, A61G; ˜T65, ˆA80; C68_, ˆC79; G7A, ˜T29, G79T; A27T; A1_, T9G, T59C; T14G, -G.79.TT; T14C, T16A; C70A, G74T; T65A, G78A; ˜T65, ˆG77; T9C, G17C, ˆG68, G77C; C66A, ˆA79; G7T, T9C, G17C; ˆG69, A76T; C2_, A21C; ˜T29, A29T; ˆG69, ˜T69; C6T, T10C, T84G; T65C, C67T; C15T; G78C; G7T, A27G, C44T; ˆC68, ˆA68; A1G, T9C, G17C, A76G; A36T, T59A; T14A, T16A; ˆC66, G79_; -T.3.AA, G7_, AG29GC, CA32TG; C8G, ˆA70, ˜T75; C66A; ˆC64, A80_; T69C; T71G, A76T; CT68TC, G74A; G54C, C68T; T9C, G17C, G81T; C2_, A13G; T65A, ˆC81; ˆC66, ˆA78; ˆC70, ˆA75; ˜T68, G77T; A29T, C50T, A53G, G79T; C68T, A76T; T16C, A18T, A80C; TGGAAGAT63, C-.66. TCGG, C68A, GGAGGGAG74_, ˆA83, A86C; -T.3.AA, G7_, AG29GC, CA32TT; T9G, A29G; C68A; A27C, A29T; A36T, G54C; ˆA4; ˆA73 |
| 2.2 to 2.3 | ˆC66, A76_; ˆG65; ˜T1, T59C; A36T; T3C, GCG5CGA, AGC29TCG, A33G; T9C, TG16GC, C68T, G79A; G7A, T14A, G17A, T34A; T65G, G79T; G7C, TC14CT, G17A, T34A; T3C, C67A; G77C, G78T; C2T, ˆG56; C6T, A83G; G7T, C8A; C66G, G79_; TG3_, C-.8.TCG, ˆC28, ˆC30, CA32_; C67T, T69G; CT2_, T9C; G78T, G79A; C2_, T9C, C15A, G17C; T9C, G17C, ˜TG67; G75T, A76C; ˆC76; G79A, A80T; TT71GG, G74C; C70_, G75C; ˆG66, G79T; T34A, A60G; A29T, C64T, C66A; ˆCT29, A88C; ˆG69; A53C, G79T; ˜T80, A80G; ˆG67, C67A; C67A, G78C; T9C, G17C, C70T, T72A; -T.3.AC, GC.7.A-, A29_, A-.33.GT; C2G, ˜T58; A27G, ˆA70; A39G, G78C; -G.78.AA, A80C; C66G, C67A; ˆG68, ˆA68; T69C, T71A; G7T, G40C, AG53GA; T9C, G17C, G79T; C8A, C66T; G74T, A80C; G7C, T14G; ˆC77, G77T; G58T, G79C; T14C; ˜T65, ˆA80, A88C; C68A, ˆC77; GC-63. ATTA, CCC66ATT, G-GG77.AATAT, GC81AT; T11G, A29T; T14A, T16G; T71C, G75A; ˜T67, ˆC78; T65C, G81A; G79C, A80T; ˆC66, ˆG74; A53C, G54A; ˆC66, ˆC79, A88C; G79C, A80G; T9C, G17C, ˆC66, ˆG74, A88C; C2_, T16C; T69G; ˆG68, ˆA76, A88C; T71A, G74C; G74T; G7T, C37A; ˆCA68, A88C; ˜T12, ˆG12; A29T, C64T, C70T; G7C, A29G; G7A, T14A, T69C, C70G; G79T, A80C; C2T, G54C; ˜T58; G7T, G30A, G81T; A29C, A83G; C2_, T69C; T3C, G5C, G7C, A29G, C31G, A33G; T72G; C64A; T34G, T59C; A1G, A60C; T65A, G79A; A27T, ˆC29; ˆG67, ˆG77; ˆG68, C68A; C64G, C66T, G77A; ˆC64, ˆA80; C2_, C73T; A29G; ˜T7; A1_, A46C, T59C; T9C, G17C, A76T; G78C, A80G; ˆC66, A76C; ˜T29, ˜T29; A27T, CT68TC, G74A; G75C, A76C; |

TABLE 98-continued

Guide 174 mutations and resulting relative enrichment

| Log₂ enrichment | Mutations on gRNA scaffold 174* (SEQ ID NO: 2238) |
|---|---|
| | ˜TT81, A88C; ˜G77, A80G; ˜C5, G7T; ˜C66, T69C; C15A, T16A; C73T; ^A65, ^A80; ˜T65, G79_; G40A, T52C; G7T, A60T; TG3GA, GC7CA, A29G, CA32TC; ˜TA70, A88C; ˜C66, ^A66; ˜G67; A36C, ˜T55, C68T; T65_; G63_, C82_; C2A, A29G |
| 2.1 to 2.2 | A83G; G75_; C68_, G79_; C2_, A46C; ˆC4; ^A69, ^A69; G42A, C50T; A53G, ˜T55; A36G, ˜C58; TG3AC, C8A, GA28TC, CA32GG, T59C, C66A; C2_, A46C, C66T; C64T, G81T; ^A68, G77T; ˜T80, A80T; T25G, A29T; G4A, C32T, G54_; ˜T68; A76C, G78A; T9C, T14C, G17C; CT2_, A33C; ˆCA65, A88C; A60C; ^A69, ˜T69; T9C, G17C, -T.65.GC; A18C, A61G, A80C; CT15TG, A21C; T72G, A76T; G7C, A29C; ˜G79, ˜C79; T69G, ˜T76; C70A, G74C; T9G, A29C; C2_, G54A; C15G, T72A, G74A; ^A75; T3_, C6T, ˆC8, A29_, C32A, ˆC34; ˆC29, A80C; G74A, A76T; C68T, T69C; T3_, C64T; A80T; CT2_, T9A; ˆC29, A36C; ˜GA67, A88C; T9C, G17C, T59A; A60T, C64T; T65A, G79T; A29C, T65C; ˜T7, A13C; C8A, C82T; A76G, ˆC77; T3G, GC7CT, GA28AG, CA32AC; -TT.71.AAGAA, G75_; G7T, C15G; ˆC79, ˆC79; TG3GA, CG6AC, A29G, CA32TC, C68T, T72C; T72C; G63C, C82T; ˜TG56, G57T; T14C, A29T, A36T; ˜T68, ˜T68; T69G, T71G; ˆG66, C66T; ˆG68, G77A; G54C, G79A; G7T, C67G; C66G, G78A; A60C, A76G, A80G; G40A, -A.76.CC; C2T, C67A, ˜T78; T9C, G17C, G77A, G79T; G77T, G78A; ˜T78, ˆC78; ˜T68, G77C; ^A67, ˆG77; C73T, G75A; A29T, C66A, G74T; C2G, A36G; T3G, G5A, GC7CA, A29G, C31T, A33C; T69A, T71C; ˆCG2, G5_C8_-G.28.CGC, CA32_; ˜GT79, A88C; C68A, G77T; C64T; G40A, G77C; C68G, C70G; C2T, G78A; T9C, G17C, ˆC66, A76C; G7T, A29G, C82T; C2_, T65G, A80G; TGG3GCT, C8G, ˆCC28, CC31_; A29G, T69C, A80G; T34A, A36_; T9C, G17C, A27G; C15T, T16C; G7T, T9C, G17C, G40A, TA52AT; A36G, T71A; C6T; ˜G69, A76_; C66A, G79A; ˆC68, ˜T68; A21T, C67A; A21C, T72G, G77T; T71G, A76G; C2T, G54A; T71G, G77A; T9C, G17C, A29G, G81A; G7A, A36T, G54C, C68T; T3A, T59A; ˜G70; ˜T77; ˜T68, ˆC77, A88C; TC14GT, T72C; T9C, G17C, T72_; ˆC73; G7C, T14C; A36T, ˜T58; G54T; T59C; A29C, C50T, A60T; G54A, C70G, ˜T75; ˆC66, G77C; C15G, G17C; C64G, ˆC81; T3A, G5C, GC7AG, GA28CT, C31G, A33G; A29C, C32A; ˜G28; A21G, A53G; G75A, A76T; G7C, TC14CT, G17C, T34A; G28A |

*mutated sequences are ';'-separated and multiple mutations per sequence are ','-separated

TABLE 99

Guide 175 mutations and resulting relative enrichment

| Log₂ enrichment | Mutations on scaffold 175* (SEQ ID NO: 2239) |
|---|---|
| 3.2 to 3.5 | C73A, ^T78; C6T, A29C, G71C, ^G80 |
| 3.1 to 3.2 | C17G, A87C; T3G, CGC6ACT, GAG28AGT, A33C; G7T, C9T, C17G, CG81GA; T16G, A29C; C9T, C17G, C65A, A87G |
| 3.0 to 3.1 | A68T, T83G; A27G, T92C; TGG3ATC, GC7AG, GA28CT, CCA31GAT; ^C65, A87G; G7T, A29T; T3G, GC7AA, GA28TT, A33C; C9T, C17G, C65_; G7T, T14G; ^G54, G78T; C9T, C17G, ^A80; TC16AT, G64C |
| 2.9 to 3.0 | C15T, T34A; C9T, C17G, A88T; G7A, C15G; ^C76, ^G76; CT2_, C15_, T58A; C2, C15G; C9T, A29C; C9T, C17G, A85T, A88T; C9T, C17G, ^CA63; G7T, C9G; A87T, A88C; C73G, G78A; A29T, A91G; TG3GA, G7A, A29G, CA32TC; ^G14, A29T, A87G; C9T, C17G, T74C; C2_, ^A53 |
| 2.8 to 2.9 | C9T, A33T; G7T, T67G, G82C; ^T5, C9_, GAGC28CGCA; G7T, ^A68, ^A82; G7T, ^C60; T14G, A29C; A29T, T66A; T3A, CG6TC, AG29GA, A33T; C2T, TC75AT; ^CG76, A88C; G7T, T14A, T83_; -T.3.GA, C6T, C9_, G28C, G30C, CA32TC; CT2_, C15T; TG3_, ^GT8, G30C, C32G; T14_, A29C; C9G, C17G, A29C, T79G; TG3AC, G7C, A29G, CA32GT, G86C, A88C; T3A, GC7CA, A29G, A33T; G7C, C80A |
| 2.7 to 2.8 | G7T, A91C; ^C2, G4C, G7_, A29_, C32G, ^G34; CT2_, A88C; C65G, A88C; G7T, -T.79.AA; A29C; T3A, GC7CA, A29G; C8G, A29C, A88_; A29T; C2_, A29C; A29C, C31T, A33G; T14G, C15T; C9T, C15A; ^GA1, G7A, C15A, C17G; C15A, T16A; CT2_, A29C; C9T, C17G, G78_; C9T, C17G, G-.78.AT; C73T, C76G |
| 2.6 to 2.7 | C9T, C17G, C65_, ^A84; C9T, C17G, G70T, C81A; T74A, T79A; T3C, C6T, AG29CA, A33G; G7A, ^T29; C76G, G77C; GG77CA, A87G; T16G, A29T; T3A, G5A, A29C, C31T, A33G; C9T, C17G, ^AA53; TG3CA, GC7AA, GA28TT, CA32TG; G7A, A29C; T3G, G7T; CT2_, A68G; T14_, A29T; C2_, C9T, C17G; ^G3, GC.7.-T, G28_, ^C34; G7T, ^T92; G7T, ^G69, G82T; ^GGCAGATCTGA64, T66C, A68C, GA71AG, ^C75, G77T, T79C, CGTAAGAA81_; T3A, C6G, AG29CC, A33T; C80T, ^A81; C81T; CT2_, C17A; C15A, T16G; C2_, T16G; G71_, C80T; TG3AC, GC7AG, GA28CT, CA32GG; |

TABLE 99-continued

Guide 175 mutations and resulting relative enrichment

| Log$_2$ enrichment | Mutations on scaffold 175* (SEQ ID NO: 2239) |
|---|---|
| | T3A, G5C, G7T, C31G, A33T; T3G, G7T, C9T, C17G; G64T, A85T; G7C, T14_; C9T, A29T; G7T, ^G14; A88G, ^C89; CT2_, A33T; C81T, ^A82; C9T, C17G, A29C, C32A; C9T, C17G, ^GA77 |
| 2.5 to 2.6 | G7C, C15G; C9T, C17G, TC75GT; TG3CA, CG6GA, AG29TC, CA32GG; G7T; T14A, T16G; G7T, C9T, G71_, ^T79; C15A; CT2_, A33T, C73_; C2A, C9T, C17G; CGC6TCA, GAG28TGA; C15G, A29C; C2_, T16G, A91C; ^T81, C81T; TG3AA, A29C, CA32TG; G4A, G7T, C32T; T3C, CGC6GCT, GAG28AGC, A33G; T3A, G7A, A29T, A33G; -G.4.CC, G7_, AGCC29GCGG; C65T, G86_; C9T, ^A16; A36G, ^C57; A1_, T16G; C6T, G7T; ^G14, A29T; ^AT16, A88C; C8G, A29C; ^G64, A87C; ^G70, ^T79; T16A, ^C29; TG3GA, C6G, C8T, GAG28ACC, CA32TC, G71T; G7T, A29C; T3G, GCG5AGT, GC30CT, A33C; ^C2, ^T14, A29T; C9T, C17G, A88_; C9T, T16A |
| 2.4 to 2.5 | TGG3ACA, A29C, CCA31TGT; T3_, G5A, G7C, ^G9, ^C28, A29G, C31T, A33_; C15A, A29T; G64A, ^T65; CT2_, A27G; ^A16, ^T16; G7T, C15A; G7T, C9T, C17G; C2G, A29T, T66A; TG3GA, CGC6TTA, G28T, G30A, CA32TC; A1C, G82C; A27C, A29C; C9T, C17G, ^GA71; T3C, ^T6, CC.8.T-, C17G, GAG28AGA, A33G, ^G54; ^T16, A27T, A29C; G64C, ^A87; ^C14, A29C; ^A65, ^T65; C2T, C9T, C17G; C9T, C17A; G70A, C81A; C2G, A36T; G5C, C8G, GA28CC, CC31GA; C6T, A29C; C80T, ^G81; T-.3.CA, G7_, AG29GC, CA32TG; ^C78, G78A; G7A, T14_, CT65TC; -T.3.AA, G7_, AG29GC, CA32TG; ^C29, A29T; G7A, A29T; TG3GA, GC7CA, A29G, CA32TC; ^T64, G64A; C15A, A29C; T75A, G77T; ^A3, ^T3; A27T, A29C; T14A, A29C; T74C, G77A; G7C, A29G; C9T, C17_; G5A, G7A, A29T, C31T; ^C63, ^A63; G7T, A91G |
| 2.3 to 2.4 | CT2_, G64T, T66G; G28T, A29C; T3G, G5T, GC7CG, GA28CG, C31A; TG3AC, G7C, A29G, CA32GT; C9T, C15A, C17G, A29C, ^TG55, G57A; ^C14, A29T; C9T, C17G, GC64TG; G7A, ^T29, A36C; ^T16, ^G54; TG3CA, C8A, GA28TC, CA32GG; G7T, C9T, C69G; C9T, C17G, ^A70; A72_, T79G; T3A, G5T, C8T, GA28AC, C31A, A33T; C9T, C17G, A29C; ^G54; G7A, TC14CT, C17A; C9T, C17G; ^G70, ^T79, A88C; ^A64, ^G64; T14G, A29T; C9T, T16_; ^A14, ^T14; ^AC1, GCG.5. - - - T, GC30_, ^GT34; A29C, A91G; C2_, T14A; C9T, ^A17; C9T, C17G, G78A; T3G, G5A, A29C, C31T, A33C; C9T, ^G17; G7T, A29G; TG3GA, C6G, C8T, GAG28ACC, CA32TC; ^T1, CG6TC, C9T, C17G; C17A; ^T17, ^A17; T3A, G5C, GC7AG, GA28CT, C31G, A33G; ^GC72, A88C; T3G, G7T, A33C; TG3CA, CG6GA, AG29TC, CA32TG; T3G, G5C, C8G, GA28CC, C31G, A33C; ^T3, C80G; C9T, C17G, T45G, ^G54; C9T, C17G, A72C, T74G; G5C, C8G, GA28AC, C31G; A29T, G56T; G7T, C63A |
| 2.2 to 2.3 | A36T, A85C, A87T; T14A, C17G; C9T, C17G, ^G54; G4C, C8G, GA28AC, C32G, A87G; ^T72; A85C, A87C; G7T, T92C; C9T, C17G, ^C63; TG3AA, C6T, AG29CA, CA32TT; C9T, C17G, A85G, A88G; G64C, ^G88; G7A, ^T29, A68C; ^A13, T14C; C9T, C17G, ^G54, A85C, A88C; -GG.4.CAT, C9_, GAGCC28CGATG; TG3AC, C6A, AG29CT, CA32GG; C9T, ^C63; C9T, A88C; A27T, A29T; C9T, C17G, ^G54, A91G; G86A, A88T; TG3CA, GC7AA, GA28TT, CA32TG, C69T; T74G, G77T; TGG3ACA, C8G, GA28CC, CCA31TGG; G7A, C17A, ^G81; G7T, A59G; ^A65, ^G86; C73T, G78T; ^C72, ^T79; A1G, C9T, C17G; ^G1, C9T, C17G; ^G72, ^C72; C2_, A29T; ^T14, A29T; ^G64, ^T87; ^A65; ^C18, ^T18; ^G64, A88C; C9A, A29C, G57T; G7C, ^G28; G77A; G7A, TC14CT, C17G; C2_; G7C, T14A, ^T86; C9T, C17G, A53G; T3G, GC7CT, GA28AG, G86T; C9T, C17G, A29C, A91G; C9T, T16_, A91C; CT2_, ^G64, C65A; C15_; T16G, C17T; G7T, G28A |
| 2.1 to 2.2 | C9T, C17G, A29T; A87C; CT18, A88C; C9T, C17G, ^G64; C17G; C15T; ^T16, T79C; A64, G64A; A1C, T3G, C9T, C17G; GA28CC, ^T65; C15A, C17A; G78C, T79G; A29C, T58G; C2_, G7A, -C.65.AA; CT2_, A29T; T3A, A33T; G4A, CGC6GTA, G28T, G30C, C32T, T67_; C9T, C17G, C65_, A91C; ^T65, A87G; A88_; G7T, C9A; C9T, C17G, C65A; TG3GC, C6T, AG29CA, C32G; G7T, T16A; G7T, G70C, C80A; G7T, T14A; TG3AA, GC7CG, GA28CG, CA32TG; ^G54, ^A91C; C73_, G78_; T3C, GC5TG, C8T, GA26_, G30A, ^CG34; ^CT3, A29C; C2T, T14G; G7C, A29T; C9T, TC16GG; T3G, C8T, GA28AC, A33C; ^G16, ^T16; C9T, C17G, A36C; TGG3AAC, C8G, GAG28_, A - - - .33.GGGT; C9T, C17G, A87G; ^T72, T79G; ^G17, C17T; CT2_, A39C, A88C; T3G, A33C; T3_, A33G; C-.2.TG, TC75CA; G7C, C9T, C17G, ^G92; C9T, C17G, G82C; C9A, A29C; C2_, C9T, C17G, A91C; C2_, A29C, A91C; CT2_, C9T, C17G, G7T, A60G; ^C71, ^T71; C2_, G77T, ^A91C; C2_, A29C; ^T71, C80G; T3A, G7A, A29G, A33T; C9T, A29G |
| 2.0 to 2.1 | C65T, ^A66; CT2_, C15_, T58A, A72C; C9T, C17G, C73A, C76A; C2_, A91C; C80T; T3A, G7C, C9T, C17G; ^C63, ^G88; G7T, A61T; GC62_, C65G, T67G, A72T, T79A, AAGA.84. - - - C, G89C; T3G, C9T, T16A, C17A; C6T, A29T; T3C, GC5CG, C8T, GAGC28ACCG, A33G; G7A, C15T; ^T2; C15G; C9G, ^29T; C15T, A29T; G7T, ^C14; ^A64, A88T; A29C, G30A; C2_, A29C, A46C; C9T, C17G, A72G, G78A; ^A87, ^T87; C9T, A59C; TG3AC, C8A, GA28TC, CA32GG; C9T, C17G, ^G64, ^G88; A29C, G71A, C80T; T3C, A29T, AC68TA; ^A17; C9T, C17G, G64T, T66C; G7A, T16G; C17T, C65G, G86C; C69T, G82C; A1T, C2A; T14A, ^C29; ^A15, C15T; |

TABLE 99-continued

Guide 175 mutations and resulting relative enrichment

| Log₂ enrichment | Mutations on scaffold 175* (SEQ ID NO: 2239) |
|---|---|
| | G7T, T16G; T3A, GC7CA, GA28TG, A33G; ^T81; T16C, A29C; A29C, A91C; G71A, A88T; ^C65, A87G, A91C; C9T, C17G, A29T, ^A53; G71T; ^A80, ^A80; C9T, C17G, A36G; C9T, C17G, T - - - .54.CTG; T16A, A29T; ^G77, T79C; C9T, C17G, G64C; TG3AC, CG6GA, AG29TC, CA32GG; A36T, C37T; A29C, ^C65, A85_; C15G, A29T; ^A70, C81T; A29T, A33G; C73A, C80T; C9T, C17G, G82_; C9T; C69T, A84G; C2_, C9T, C17G, A46C |
| 1.9 to 2.0 | C2_, A29G, A91C; A68G, T83C; C9T, T14A, C17A, ^AG85; ^T66, ^G85; G62T, CT65_, C69A, G71A, C80T, G82T, A85C, AGC88_; T3_, G5T, ^A8, -A.29.TC, C31A, A33_; G7A, T14C, C17A; T3G, CG6TC, AG29GA; ^T54; ^C8, ^T8; G7T, AA87TG; A72C, C73A; C2_, C6T; ^C29; G71C, C81_; C9T, C17G, G64_, A88_; C2_, A88T; T3G, G5C, GC7TG, G28C, C31G; C9T, C15T, C17G, A36C; G7T, T34G; T14A; ^T73, ^C78; ^G64; ^G15, C15T; A36C, ^A57; A-.72.GC, ^T79; T16A, A29C, ^A58; C9T, C17G, ^T52; C2_, A85T; ^C29, A29G; G7T, T14C; C2A, ^T57; G7T, C15G, T34G; T14G, C17T; T14C, C15T; T3G, G5A, GC7TA, G28T, C31T, A33C; ^C71, ^T79; ^T14, A29C; ^A1, A36C; ^C63, ^G89; G7C, A91G; T14C, A29C; C9T, C17G, G78T, C80T; ^G69, G82C; TGG3GCA, G7T, CCA31TGC; C6T, A29C, G71C, ^G80, A91C; A13C, A29C; ^C63, A88T; G7T, T14_; C2_, GG77AA; C9T, C17G, T58A; C2_, G77T; C2_, T3_; C9T, C17G, ^AA53, A88C; G7T, C9T; G7A; CG6GC, AG29GC, C32A; C63T, TTA66GCC, GA71_, TC79_, TAA83GGC, A87C, G89_; G7C, C17G; C2_, A46C; C9G, A29T, C37T, ^A56 |
| 1.8 to 1.9 | ^G69, A72C, G82C; ^G70, T79G; G7A, C15A; ^T36, ^A57; ^G70, ^C79; TGGCG3CACAT, GCCA30TGTG; G71A; TG3AC, C8A, A29C, CA32GT; T10G, A29C; ^A65, G77A, ^G86; C9T, C17G, A88_, A91C; ^C78, ^A78; G7T, C90T; T3G, G5A, GC7TG, G28C, C31T, A33C; G7T, C9G, G86T; A29C, C31T, A33C; A29C, G70A; A-.88.GC, A91C; ^A17, A36C; T3C, GCG5TGA, AGC29TCA, A33G; T3C, CGC6GCT, GAG28AGA, A33G, A88C; C35G, ^C58; T74A, G78C; C9T, CA17GT; G7A, C17G; C9T, C17G, ^GT70; CTG2_, A29C; C2_, A68G; ^T64, ^T88; T3G, A33T; C2_, T16G, A29C; ^A1; A36T, ^G55; C9T, C17G, C63A; C9T, A18G; C2T, A36T; ^A81, ^A81; C9T, T14G, C17G; -A.72.CC, A91C; A29T, T79G; G7A, A29T, A59G; G7C, ^C78; ^AG64, A88C; CT2_, C9T, C17G, C69T; C2_, A46C, A91C; ^C89, A91C; ^C29, A68C; C2_, G64T; -C.15.GT, A27C; CT2_, T10G, A88C; T14C, A29T; C9T, C17G, C76T; A84G, A87C; G7C, C9T, T14A, C17G, T34A; G70T, C81A; T14G; ^T3, A29T; G7T, ^T29; A29T, C65A, T67G; G64C, A87G; C9T, T14A, C17G; ^T57, A87G; TGG3ATC, A29C, CCA31GAT |
| 1.7 to 1.8 | C2_, G70A; C9T, C17G, ^GA77, A88C; C9G, C17G, A29C; ^T70, ^T81; G7C, C9T, C17G; T3G, CGC6TTG, G28C, G30A, A33C; ^A16, A68T; C9T, C17G, T67C; G7T, ^C14, A33C; G7A, T14_; ^C14, ^T14; C9T, C17G, GG77TT; C2T, C80T; ^T64, A88_; ^G54, A68C; G7T, CT9AG; C9T, C17G, T79G; T79G, C80T; ^AT3, A88C; ^AG54, A88C; C2G, A33C; C2_, A88T, A91C; C9T, C17G, T58C; C2_, C73T; TGG3CCC, C8G, GA28CC, CCA31GGG; G7T, T10G; C9T, C17G, ^A80, A91C; ^T64; T14_, A29C, A91C; G7A, G28T, AAAGCGCTTA59_; G7T, G71_; ^A17, ^A17; T14_, A29T, A91C; C17G, A72G, T74C; ^T88; CT2_, A94C; A27G, A29C; A85T, A87G; C9T, C17G, ^AA79; C9T, T14A, C17G, T34A, ^G64, G86T; C9T, C17G, T45G; C2_, C9T, C17G, C65T; ^G3, G5C, C9_, GA28CG, C32A; T74G, G78T; TG3_, - - - C.8.GCT, G28_, ^G33; A39T, T54A; C2_, A72G; C9T, C15T, C17G; TG3CA, CG6GA, AG29GC, CA32TG; G64C, A88G; C15A, C17G; C2_, C65A; ^G64, G86A; ^C29, A36C; G64T, T66A; TG3GT, A29C, C32A; ^A64; C81G; C9T, A72T, T79C; C9T, C17G, G77T |
| 1.6 to 1.7 | A72G; ^C14, A29C, A36C; T3C, C9T, C17G; G4C, C8G, GA28AC, C32G; C2_, G71C, ^G80; C76T; C9T, T14A; C2G, C9T, C17G; G70T, C81G; C17G, ^T54; A72C; C2_, C9G, C17G; TG3GC, C8T, GA28AC, C32G; TGG3GCT, C8G, ^CC28, CC31_; C9T, C17G, A39T, A-.53.GC; ^T16; T67C, A87C; ^G81, C81T; C76G, G78C; A1C, G56A; TG3CA, GC7AG, GA28CT, CA32GG; C9T, C17G, C65G, ^A87; G86A, A88C; G7T, C9T, C17G, ^A72, G78A; ^G70, C80A; ^A17, A68C; C2_, C80G; ^C71, ^T79, A88C; C9T, C17G, ^T57; ^T2, C9T, C17G; T45G; G64C; T14_; C65T, G86A; C69T; ^C65; G64T, C65A; T3G, GC7CT, GA28AG; ^A1, ^A53; T3A, G5C, GC7AT, GA28AT, C31G, A33T; C9T, C17G, ^CA72; C9T, C17G, C73A, T79A; C2_, A53G; TGG3GTC, C8G, GA28CC, CC31GA; ^C5, G7T, C9T, C17G; G71T, C80T; C15T, T16G; G7C, C9T, C17G, C76A, G78T; G64T, T66C; ^C65, A91C; C73T; A72C, G78T; ^C63; A68G, C81T; ^GT87, A88C; C9T, C17G, ^A78; T3A, GC5AG, C8T, GAGC28ACCT, A33T; ^A1, ^T54; A29C, G56A; C2_, C80T; ^TA17, A88C; A72G, C73T; A29C, C31T, T83C; G7T, A27T; T3C, G7T, G40A, ^T54; A88C;; G64T, A87C; T3_, ^T9, G28_, ^G32; ^GT16, A88C; -T.3.AC, G7A, C9_GAG28TGC, CA32GG, A84G, G86T; ^T65; C76A, G77T; ^G14, A29C; G64C, A88C; A72_, T79G, A91C; ^C29, A68C, A72C; TG3AT, GC7TT, G28A, CA32AT; C9T, C17G, T - - - .54.CTG, A88C; G7T, A59C; CC8GT, C17G; G7C, T14C, ^T86; ^CA3, GC5_, C8G, GA26_, G30C, ^TG34 |
| 1.5 to 1.6 | T3A^, A5, G7_, AGC29GCT, A33G; C9T, C17G, ^C73, G78C; G71A, A72G; AG27TA, A88T; G7T, A91T; ^T57, A91C; ^T2, A68C; ^T2, A36C; G7T, T10C; ^A64, A88G; TG3CA, C6T, C8T, GAG28ACA, CA32TG; ^T54, ^68C, A72C; G7T, A61G; GCGC5CAAG, GAGC28CTTG; C6T, CT9TC, C17G, A29C; |

TABLE 99-continued

Guide 175 mutations and resulting relative enrichment

| Log₂ enrichment | Mutations on scaffold 175* (SEQ ID NO: 2239) |
|---|---|
| | ^CA63, A88C; C2_, C9T, C17G, A36C; ^G64, ^G86; <br> ^CGGCAGAT65, T67G, ^GC69, G70T, A72G, ^GCTC75, G77T, T79C, CGTAA81_; <br> C73T, ^G74; T14G, T16A; ^AT14, A88C; G64C, A88T; C2_, A39T, ^A55; <br> C2_, C15T; ^G70, C81T; ^A81, C81T; T72, A72T; C2_, C69T; T75G, T79G; <br> A88_, A91C; ^T7, G7T; G7A, A29T, ^A77; CC8AT, C17G; C2_, T52C; <br> G7A, C9T, TC16CG; G70A; C9T, C17G, AA87TC; ^A53, A91C; <br> T3A, G5C, GC7CT, GA28AG, C31G, A33T; ^G70, ^C79, A88C; ^T72, ^G77; <br> C9T, C17G, C69T; T-.3.CA, G7A, C9_, AG29GC, CA32TG; <br> TGG.3.-AA, ^G9, ^CGC28, A29T, CCA31_; GCGC.62. - - - AA, <br> T67C, C69A, GA71AC, TC79GT, G82T, AAGA.84 - - - G, GC89TT; <br> A85G, A87G; TG3_, C - - - .8.TCG, GAG28CGA, C32G; T66C, A85G; <br> ^A16, G86T, A88T; TT74GG, G - - - .77.AAC; C2_, T79C, C9T, ^A13, C17G, ^G54; <br> ^C63, G64T; C2_, T83C; ^C73, ^C73; -T.3.AA, G7_, A29_, A-.33.GT, G70A; <br> ^T16, A91C; ^T64, ^G64; T79C; C9T, C17G, G77A; ^T64, ^T64; C2_, G71A; <br> T14C, C17G; G7C, TC14CA, C17G; A85C, A88C; <br> ^A3, GG4TC, C9_, GA28CG, CCA31AAT; - - - C.63.TTT, C65_, CGGA.69.T - - - , <br> TCCG.79. - - - A, G86C, G89A; C9T, C17G, ^C57; C15G, T16A; C9T, C17G, ^CA64; <br> AG39TA, T52C, T54A; C2A, A87G |
| 1.4 to 1.5 | -C.15.GT, A36C; A29C, T83C; G7T, A27G; ^C29, ^C29; ^T80, ^C80; <br> TGGC3ACAG, GA26_, - - - A.33.TGG; A72G, ^T73; C9T, C17G, T66A, A85G; <br> ^C15, ^G15; TG3_, - - - C.8.GCT, GAG28CGC, C32G; ^T19; G28A, A29C; <br> ^G70, ^G80; CT2_, A36C, A39C; C9T, C17G, ^CC79; ^G54, A68C, A72C; <br> ^CT78, A88C; T74G, G78C; TTC74AGG, ^AT78; C9T, C17G, C76G; <br> ^GGCAGCTCTGA64, T66C, A68C, GA71AG, ^C75, G77T, T79C, CGTAAGAA81_; <br> ^A1, A68C; ^A4; A72G, G78C; T3G, C8T, GA28CC, A33C; G7C, -C.80.AT; <br> C9T, C17G, A59T; G26C, C93G; G7C, T14A, ^T86, A91C; ^G64, ^T87, A88C; <br> A1G, A29C; C9T, C17G, ^AT78; G28T, GCCA30TTTG; C2_, T75A, G78A; <br> TG3GA, CG6AC, AG29GT, CA32TC; A36G, ^C57, A91C; ^C72, A72C; <br> C9T, C17G, ^G82; A27T; TG3CC, CGC6TTG, G28C, G30A, CA32GG, C80G; <br> ^A1, ^A53, A88C; A72C, C80A; G7T, C73G; ^A15, A87G; T14_, ^C29; <br> G7A, T14_, A91C; C15T, T16A; C15T, C17G; C65_, A88_, A94C; ^A16; <br> C9T, C17G, ^G54, A68C; -T.3.AC, G5A, C9_, GAG28CGT, CA32GG; ^T15, ^C15; <br> C9T, T14A, C17G, T34C; ^G64, G86T; ^T71, C80G, A91C; -C.15.GT, A68C; <br> ^G87, ^T87; C73_, G78_, A94C; C2G; G77C, T79A; G70C; A68G; ^T81, A91C; <br> C9T, C17G, T79A; ^T72, ^T72 |
| 1.3 to 1.4 | T66A, A88C; C76G, G77T; A53G, A59C; CTG2_, G7T; A72_, ^T79; <br> ^AA80, A88C; TGG3CAA, C8G, GA28CC, CCA31TGG; ^C78, <br> ^T78; - - - G28.TGA, T79C; ^T72, ^G77, A88C; A72G, ^C79; <br> T3G, G5A, G7A, A29G, C31T, A33C; T14G, A21G; ^T2, A72C; G7T, T14G, ^CG64; <br> T3G, G71A; G64A, A87G; T3C, C6T, AG29CC, A33G; T45A; <br> G7A, C9T, T14A, C17G; TG3CT, CGC6TAT, GAG28ATA, CA32AG; <br> C9T, C17G, ^T83; G7T, C9T, A53T; C9T, C17G, T75G; G7C, T14C, A72_; <br> ^A65, A87G, ^C89; C9T, C17G, G70C, C81G; G7T, A59T; AG29CA, A72T, ^G77; <br> T74C, G78A; C2A; C9T, C17G, C73T, T75G; ^G54, A72C; ^AA81, A88C; <br> ^T54, A68C; C65A, G86A; ^A1, A72C; T3G, C9T, C17G; C2_, A33T; A87T; <br> ^A65, ^T86; A53G; A85G, A87C; T3G, G5C, GC7TG, G28C, C31G, TC75_; -T.3.AC, <br> G7A, C9_, GAG28TGC, CA32GG, G71T; G7C, C15A; G64A, A85G, A88_; <br> ^A74; ^TG64, A88C; A29C, A60T; C9T, C17G, C80G; ^T64, ^A87; G7T, ^A59; <br> G77C, G78C; A72C, ^T79; ^T73, ^C78, A88C; ^C29, A91C; ^A64, A88C; <br> ^G54, T58A; TGGCG3CACTT, GCCA30AGTG; C9T, C17G, A21T; <br> G4C, C8G, GA28AC, C32G, ^G82; A36C, A53G; C9T, C17G, G71T; <br> C9T, CA17GT, T45A, G70C; ^A81; G7A, A72T; CT2_, T10G; G64T, A87G; <br> ^G70, T79A; C2_, C9T, C17G, T52C; C2_, T45C; C9T, C17G, ^C35, A36G; <br> G7T, T58A; ^A73, ^C73 |
| 1.2 to 1.3 | C2G, C73G; G7T, ^T14; T75C, C76T; ^A80, ^C80; A1_, A46C; C9T, C17_, A91C; <br> C35G, ^C58, A68C; C2T, T3A; ^C29, A72C; T79G, C80A; G71A, C81_; <br> G7T, G28T; CT2_, T45G; A29C, ^G92; C9T, C17G, T67C, A84G; <br> T3C, ^T6, C9_, GAG28AGA, A33G; A36T; A85C, A88T; <br> TG3GC, C6A, C8T, GAG28ACT, CA32GC; T10C, A29C; A1_, C2_; ^C65, A87T; <br> A72T, C81T; C15A, T79A; ^GA1, G7A, C15A, C17G, A88C; ^A16, T16A; <br> A29T, A60C; C76A, G78A; A29T, C31T; A29C, G86C; ^G70, T79G, A91C; <br> ^T54, A72C; ^GAAC73, T74A, GG.77.C-; T14_A29C, A46C; <br> C9T, C17G, ^A72, ^A78; T14C, C15A; ^A17, ^G17; C9T, C17G, CG76AC; <br> T74C, T79C; G7A, TC14AA, C17A; ^T64, ^A64; ^T81, ^A81; C2A, A36T; <br> C9T, C17G, G82T; T74A, G77A; ^A1, A33C, A36C; G7C, TC14CT, T34A; <br> A36T, A53G; ^A65, ^A84; A1_; G7T, ^T60; <br> T3A, G5C, G7T, C31G, A33T, T52G, ^C54; T75G, G77T; G5C, G7A, A29T, C31T; <br> TGGC3CCAG, C8T, GA26_, G30A, - - - A.33.TGG; C9T, ^C17; C2_, T14A, A91C; <br> G77A, G78T; ^G64, G86A, A91C; T16A, C17G; C9T, C17G, T34A; A87G; <br> A39G, -T.54.GC; A39G, -T.54.GC, A91C; ^A5, C6T, C9_, G28C, GC30CT; A72C, <br> G77A; C2_, A91C, A94C; C2_, G7C; A84G; C73A, G78T; ^T78, ^A78; <br> TGG3GTC, C8G, GA28AC, CCA31GAC; G7A, ^G14; C76T, G77A; C2_, G7T; <br> G7A, T14A; ^A17, A68C, A72C; TGG3CCA, GC7CG, GA28CG, CCA31TGG; |

TABLE 99-continued

Guide 175 mutations and resulting relative enrichment

Log$_2$ enrichment Mutations on scaffold 175* (SEQ ID NO: 2239)

T79G; ^A72, ^C78; C15G, A29T, G57C, A59T; T14A, ^G74; G7T, C65T, A87C; C9T, C17G, G70T

*mutated sequences are ';'—separated and multiple mutations per sequence are ';'—separated

Example 37: The CcdB Selection Assay Identifies CasX Protein Variants with Improved dsDNA Cleavage or Improved Spacer Specificity at TTC, ATC, and CTC PAM Sequences Experiments were conducted to identify the set of variants derived from CasX 515 (SEQ ID NO: 196) that are biochemically competent and that exhibit improved activity or improved spacer specificity compared to CasX 515 for double-stranded DNA (dsDNA) cleavage at target DNA sequences associated with a PAM sequence of either TTC or ATC or CTC. In order to accomplish this, first, a set of spacers was identified with survival above background levels in a CcdB selection experiment using CasX 515 and guide scaffold 174. Second, CcdB selections were performed with these spacers to determine the set of variants derived from CasX 515 that are biochemically competent for dsDNA cleavage at the canonical "wild-type" PAM sequence TTC. Third, CcdB selection experiments were performed to determine the set of variants of CasX 515 that enable improved dsDNA cleavage at either PAM sequences of type ATC or of type CTC. Fourth, plasmid counter-selection experiments were performed to determine the set of variants derived from CasX 515 that resulted in improved spacer specificity.

Experiments were conducted to identify the set of variants derived from CasX 515 (SEQ ID NO: 196) that are biochemically competent and that exhibit improved activity or improved spacer specificity compared to CasX 515 for double-stranded DNA (dsDNA) cleavage at target DNA sequences associated with a PAM sequence of either TTC or ATC or CTC. In order to accomplish this, first, a set of spacers was identified with survival above background levels in a CcdB selection experiment using CasX 515 and guide scaffold 174. Second, CcdB selections were performed with these spacers to determine the set of variants derived from CasX 515 that are biochemically competent for dsDNA cleavage at the canonical "wild-type" PAM sequence TTC. Third, CcdB selection experiments were performed to determine the set of variants of CasX 515 that enable improved dsDNA cleavage at either PAM sequences of type ATC or of type CTC. Fourth, plasmid counter-selection experiments were performed to determine the set of variants derived from CasX 515 that resulted in improved spacer specificity.

Materials and Methods:

For CcdB selection experiments, 300 ng of plasmid DNA (p73) expressing the indicated CasX protein (or library) and sgRNA was electroporated into *E. coli* strain BW25113 harboring a plasmid expressing the CcdB toxic protein. After transformation, the culture was allowed to recover in glucose-rich media, after which IPTG was added and the culture was further incubated for an additional 40 minutes. A recovered culture was then titered on LB agar plates (Teknova Cat #L9315) containing an antibiotic selective for the plasmid. Cells were titered on plates containing either glucose (CcdB toxin is not expressed) or arabinose (CcdB toxin is expressed), and the relative survival was calculated and plotted, as shown in FIG. 138. Next, a culture was electroporated and recovered as above, and a fraction of the recovery was saved for titering. The remainder of the recovered culture was split after the recovery period, and grown in media containing either glucose or arabinose, in order to collect samples of the pooled library either with no selection, or with strong selection, respectively. These cultures were harvested and the surviving plasmid pool was extracted using a Plasmid Miniprep Kit (QIAGEN) according to the manufacturer's instructions. The entire process was repeated for a total of three rounds of selection.

The final plasmid pool was isolated and a PCR amplification of the p73 plasmid was performed using primers specific for unique molecular identifier (UMI). These UMI sequences had been designed such that each specific UMI is associated with one and only one single mutation of the CasX 515 protein. Typical PCR conditions were used for the amplification. The pool of variants of the CasX 515 contained many possible amino acid substitutions, as well as possible insertions, and single amino acid deletions in an approach termed Deep Mutational Evolution (DME). Amplified DNA product was purified with Ampure XP DNA cleanup kit. Amplicons were then prepared for sequencing with a second PCR to add adapter sequences compatible with next-generation sequencing (NGS) on either a MiSeq instrument or a NextSeq instrument (Illumina) according to the manufacturer's instructions. NGS of the prepared samples was performed. Returned raw data files were processed as follows: (1) the sequences were trimmed for quality and for adapter sequences; (2) the sequences from read 1 and read 2 were merged into a single insert sequence; and (3) each sequence was quantified for containing a UMI associated with a mutation relative to the reference sequence for CasX 515. Incidences of individual mutations relative to CasX 515 were counted. Mutation counts post-selection were divided by mutation counts pre-selection, and a pseudocount of ten was used to generate an "enrichment score". The log base two (log$_2$) of this score was calculated and plotted as heat maps in which the enrichment score for biological replicates for a single spacer was determined at each amino acid position for insertions, deletions, or substitutions (not shown). The library was passed through the CcdB selection with two TTC PAM spacers performed in triplicate (spacers 23.2 AGAGCGTGATATTACCCTGT, SEQ ID NO: 35158, and 23.13 CCCTTTGACGTTG-GAGTCCA, SEQ ID NO: 35159) and one TTC PAM spacer performed in duplicate (spacer 23.11 TCCCCGA-TATGCACCACCGG, SEQ ID NO: 35160), and the mean of triplicate measurements was plotted on a log$_2$ enrichment scale as a heatmap for the measured variants of CasX 515. Variants of CasX 515 that retained full cleavage competence compared to CasX 515 exhibited log$_2$ enrichment values around zero; variants with loss of cleavage function exhibited log$_2$ values less than zero, while variants with improved cleavage using this selection resulted in $\log_2$ values greater than zero compared to the values of CasX 515. Experiments to generate additional heat maps (not shown) were performed using the following single spacers (11.2 AAGTGGCTGCGTACCACACC, SEQ ID NO: 35161; 23.27 GTACATCCACAAACAGACGA, SEQ ID NO: 35162; and 23.19 CCGATATGCACCACCGGGTA, SEQ ID NO: 35163, respectively) for selectivity.

For plasmid counter-selection experiments, additional rounds of bacterial selection were performed on the final plasmid pool that resulted from CcdB selection with TTC PAM spacers. The overall scheme of the counter-selection is to allow replication of only those cells of *E. coli* which contain two populations of plasmids simultaneously. The first plasmid (p73) expresses a CasX protein (under inducible expression by ATc) and a sgRNA (constitutively expressed), as well as an antibiotic resistance gene (chloramphenicol). Note that this plasmid can also be used for standard forward selection assays, such as CcdB, and that the spacer sequence is completely free to vary as desired by the experimentalist. The second plasmid (p74) serves only to express an antibiotic resistance gene (kanamycin) but has been modified to contain (or not contain) target sites matching the spacer encoded in p73. Furthermore, these target sites can be designed to incorporate "mismatches" relative to the spacer sequence, consisting of non-canonical Watson-Crick base-pairing between the RNA of the spacer and the DNA of the target site. If the RNP expressed from p73 is able to cleave a target site in p74, the cell will remain only resistant to chloramphenicol. In contrast, if the RNP cannot cleave the target site, the cell will remain resistant to both chloramphenicol and kanamycin. Finally, the dual plasmid replication system described above can be achieved in two ways. In sequential methods, either plasmid can be delivered to a cell first, after which the strain is made electrocompetent and the second plasmid is delivered (both by electroporation). Previous work has shown that either order of plasmid delivery is sufficient for successful counter-selection, and both schemes were performed: in an experiment named "Screen 5", p73 is electroporated into competent cells harboring p74, while in Screen 6 the inverse is true. Cultures were electroporated, recovered, titered, and grown under selective conditions as above for a single round, and plasmid recovery followed by amplification, NGS, and enrichment calculation were also performed as above.

Finally, additional CcdB selections were performed in a similar manner, but with guide scaffold 235 and with alternative promoters WGAN45, Ran2, and Ran4, all targeting the toxic CcdB plasmid with spacer 23.2. These promoters are expected to more weakly express the guide RNA compared to the above CcdB selections and are thus expected to reduce the total concentration of CasX RNP in a bacterial cell. This physiological effect should reduce the overall survival of bacterial cells in the selective assay, thus increasing the dynamic range of enrichment scores and correlating more precisely with RNP nuclease activity at the TTC PAM spacer 23.2. For each promoter, three rounds of selection were performed in triplicate as above, and each round of experimentation resulted in enrichment data as above. These experiments are hereafter referred to as Screen 7.

Results:

The results of the library screen heat maps demonstrated that CasX 515 complexed with guide scaffold 174 was capable of cleaving the CcdB expression plasmid when targeted using spacers (listed below) that target DNA sequences associated with TTC PAM sequences. In contrast, spacers utilizing alternative PAM sequences exhibited far more variable survival. ATC PAM spacers (listed below) ranged in survival from a few percent to much less than 0.1%, while CTC PAM spacers (listed below) enabled survival in a range from >50% to less than 1%. Finally, GTC PAM spacers (listed below) only enabled survival at or below 0.1%. These benchmarking data support the experimental design of this selection pipeline and demonstrate the robust selective power of the CcdB bacterial assay. Specifically, CasX proteins unable to cleave double-stranded DNA are de-enriched by at least four orders of magnitude, while CasX proteins biochemically competent for cleavage will survive the assay.

Heatmaps were used to identify the set of variants of CasX 515 that were biochemically competent for dsDNA cleavage at target DNA sequences associated with a TTC PAM sequence, as well as those variants exhibiting improved for dsDNA cleavage at target DNA sequences associated with PAM sequences of CTC (spacers 11.2 and 23.27) and ATC (spacer (23.19).

These three datasets, either individually, or combined, represent underlying biochemical differences between variants and identify regions of interest for future engineering of improved CasX therapeutics for human genome editing. As evidence for this, internal controls were included uniformly as part of the naïve library, such as the presence of a stop codon at each position throughout the protein. These stop codons were consistently observed to be lost throughout rounds of selection, consistent with the expectation that partially truncated CasX 515 should not enable dsDNA cleavage. Similarly, variants with a loss of activity reflected in the heatmap data were observed to have become depleted during the selection, and thus have a severe loss of fitness for double-stranded DNA cleavage in this assay. However, variants with an enrichment value of one or greater (and a corresponding $\log_2$ enrichment value of zero or greater) are, at minimum, neutral with respect to biochemical cleavage. Importantly, if one or more of the mutations identified in this specific subset of variants exhibit desirable properties for a therapeutic molecule, these mutations establish a structure-function relationship shown to be compatible with biochemical function. More specifically, these mutations can affect properties such as CasX protein transcription, translation, folding, stability, ribonucleoprotein (RNP) formation, PAM recognition, double-stranded DNA unwinding, non-target strand cleavage, and target strand cleavage.

For those variants competent for cleavage at sequences associated with CTC and ATC PAM sequences, enriched variants in these datasets (enrichment >1, equivalent to $\log_2$ enrichment for values of approximately 0) represent mutations that specifically improve cleavage of CTC or ATC PAM target sites. Mutations meeting these criteria can be further subcategorized in two general ways: either the mutation improves cleavage rates by improving the recognition of the PAM (Type 1) or the mutation improves the overall cleavage rate of the molecule regardless of the PAM sequence (Type 2).

As examples of the first type, substitution mutations at position 223 were found to be enriched by several hundred-fold in all samples tested. This location encodes a glycine in both wild-type reference CasX proteins CasX 1 and 2, which is measured to be 6.34 angstroms from the −4 nucleotide position of the DNA non-target strand in the published CryoEM structure of CasX 1 (PDB ID: 6NY2). These substitution mutations at position 223 are thus physically proximal to the altered nucleotide of the novel PAM, and likely interact directly with the DNA. Further supporting this conclusion, many of the enriched substitutions encoded amino acids which are capable of forming additional hydrogen bonds relative to the replaced amino acid (glycine). These findings demonstrate that improved recognition of novel PAM sequences can be achieved in the CasX protein by introducing mutations that interact with one or both of the DNA strands, especially when physically proximal to the PAM DNA sequence (within ten angstroms). Additional features of the heat maps for ATC and CTC spacers represented mutations enabling increased recognition of non-canonical PAM sequences, but their mechanism of action has not yet been investigated.

As examples for the second type of mutation, the results of the heat maps were used to identify mutations that improve the overall cleavage rate compared to CasX 515, but without necessarily specifically recognizing the PAM sequence of the DNA. For example, a variant of CasX 515 consisting of an insertion of arginine at position 27 was measured to have an enrichment value greater than one in the selection with spacer 11.2 (CTC PAM) and spacer 23.19 (ATC PAM). This variant had previously been identified by a comparable selection on a CTC PAM spacer, where this mutation was enriched by orders of magnitude (data not shown). The position of this amino acid mutation is physically proximal (9.29 angstroms) to the DNA target strand at position −1 in the above structural model. These insights suggest a mechanism where the mature R-loop formed by CasX RNP with double-stranded DNA is stabilized by the side chain of the arginine, perhaps by ionic interactions of the positively charged side chain with the negatively charged backbone of the DNA target strand. Such an interaction is beneficial to overall cleavage kinetics without altering the PAM specificity. These data support the conclusion that some enriched mutations represent variants that improve the overall cleavage activity of CasX 515 by physically interacting with either or both of the DNA strands when physically proximal to them (within ten angstroms).

The data support the conclusion that many of the mutations measured to improve cleavage at sequences associated with the CTC or ATC PAM sequences identified from the heat maps can be classified as either of the two types of mutations specified above. For mutations of type one, variants consisting of mutations to position 223 with a large enrichment score in at least one of the spacers tested at CTC PAMs are listed in Table 100, with the associated maximum enrichment score. For mutations of type two, a smaller list of mutations was chosen systematically from among the thousands of enriched variants. To identify those mutations highly likely to improve the overall cleavage activity compared to CasX 515, the following approach was taken. First, mutations were filtered for those which were most consistently enriched across CTC or ATM PAM spacers. A lower bound (LB) was defined for the enrichment score of each mutation for each spacer. LB was defined as the combined $\log_2$ enrichment score across biological triplicates, minus the standard deviation of the $\log_2$ enrichment scores for the individual replicates. Second, the subset of these mutations was taken in which LB>1 for at least two out of three independent experimental datasets (one ATC PAM selection and two CTC PAM selections). Third, this subset of mutations was further reduced by excluding those for which a negative $\log_2$ enrichment was measured in any of the three TTC PAM selections. Finally, individual mutations were manually selected based on a combination of structural features and strong enrichment score in at least one experiment. The resulting 274 mutations meeting these criteria are listed in Table 101, along with the maximum observed $\log_2$ enrichment score from the two CTC or one ATC PAM experiments represented in the resulting heat maps, as well as the domain in which the mutation is located.

In contrast to Class I mutations, there exists another category of mutations that improve the ability of the CasX RNP to discriminate between on-target and off-target sites in genomic DNA, as determined by the spacer sequence, termed Class II, which improve the spacer specificity of the nuclease activity of the CasX protein. Two additional experiments were performed to specifically identify Class II mutations, where these experiments consisted of plasmid counter-selections and resulted in enrichment scores representing the sensitivity of the generated variant, compared to CasX 515, to a single mismatch between the spacer sequence of the guide RNA and the intended target DNA. The resulting enrichment scores were ranked for all observed mutations across the experimental data, and the following analyses were performed to identify a subset of mutations likely to improve the spacer specificity of the CasX protein without substantially reducing the nuclease activity at the desired on-target site. First, mutations from Screen 5 were ranked by their average enrichment score across three technical replicates using Spacer 23.2. Those mutations which were physically proximal to the nucleotide mismatch, as inferred from published models of the CasX RNP bound to a target site (PDB ID: 6NY2), were removed in order to discard those Class II mutations that might only confer improvements to specificity at Spacer 23.2 only, rather than universally across spacers. Finally, these Class II mutations were discarded if their cleavage activity at on-target TTC PAM sites was negatively impacted by the mutation if their average log 2 enrichment from the three TTC PAM CcdB selections was less than zero. The resulting mutations meeting these criteria are listed in Table 101, along with the maximum observed $\log_2$ enrichment score from Screen 5 and the domain in which the mutation is located. Additionally, Class II mutations were identified from the counter-selection experiment Screen 6. These mutations were similarly ranked by their mean enrichment scores, but different filtering steps were applied. In particular, mutations were identified from each of the following categories: those with the highest mean enrichment scores from either Spacer 23.2, Spacer 23.11, or Spacer 23.13; those with the highest combined mean enrichment scores from Spacer 23.2 and Spacer 23.11; those with the highest combined mean enrichment scores from Spacer 23.11 and Spacer 23.13; or those with the highest combined mean enrichment scores from Spacer 23.2 in Screen 5 and Spacer 23.2 in Screen 6. These resulting mutations are listed in Table 102, along with the maximum observed log 2 enrichment score from Screen 6 and the domain in which the mutation is located.

In addition to the Class I or Class II mutations, there exists another category of mutations that has been directly observed to improve the dsDNA editing activity at TTC PAM sequences. These mutations, termed Class III mutations, demonstrated improved nuclease activity by way of exhibiting enrichment scores above that of CasX 515 when targeting the CcdB plasmid using Spacer 23.2 in Screen 7. A computational filtering step was used to identify a subset of these enriched mutations which are of particular interest. Specifically, mutations were identified that had an average enrichment value across three replicates that was greater than zero for each of the three promoters tested. Finally, features of the enrichment scores across the amino acid sequence were used to identify additional mutations at enriched positions. Example features of interest included the following: insertions or deletions at the junction of protein domains in order to facilitate topological changes; substitutions of an amino acid for proline in order to kink the polypeptide backbone; substitutions of an amino acid for a positively charged amino acid in order to add ionic bonding between the protein and the negatively charged nucleic acid backbone of either the guide RNA or either strand of the target DNA; deletions of an amino acid where consecutive deletions are both highly enriched; substitutions to a position that contains many highly enriched substitutions; substitutions of an amino acid for a highly enriched amino acid at the extreme N-terminus of the protein. These resulting mutations are listed in Table 103, along with the maximum observed log 2 enrichment score from Screen 6 and the domain in which the mutation is located.

TABLE 100

Mutations to CasX 515 (SEQ ID NO: 196) that improve cleavage activity at CTC PAM sequences by physically interacting with the PAM nucleotides of the DNA

| Position | Reference | Alternate | Maximum observed log2 enrichment in Ccdb selections | Domain |
| --- | --- | --- | --- | --- |
| 223 | G | Y | 4.6 | helical I-II |
| 223 | G | N | 5.7 | helical I-II |
| 223 | G | H | 4.2 | helical I-II |
| 223 | G | S | 4.6 | helical I-II |
| 223 | G | T | 3.8 | helical I-II |
| 223 | G | A | 6.3 | helical I-II |
| 223 | G | V | 3.6 | helical I-II |

TABLE 101

Mutations to CasX 515 (SEQ ID NO: 196) systematically identified from all datasets to improve cleavage activity at ATC and CTC PAM sequences

| Position | Reference | Alternate | Maximum observed log$_2$ enrichment in CcdB selections | Domain |
| --- | --- | --- | --- | --- |
| 3 | — | G | 3.0 | OBD-I |
| 3 | I | G | 3.5 | OBD-I |
| 3 | I | E | 4.5 | OBD-I |
| 4 | — | G | 2.5 | OBD-I |
| 4 | K | G | 2.5 | OBD-I |
| 4 | K | P | 3.1 | OBD-I |
| 4 | K | S | 3.3 | OBD-I |
| 4 | K | W | 2.8 | OBD-I |
| 5 | — | P | 3.5 | OBD-I |
| 5 | — | G | 3.1 | OBD-I |
| 5 | R | S | 3.7 | OBD-I |
| 5 | — | S | 2.2 | OBD-I |
| 5 | R | A | 3.2 | OBD-I |
| 5 | R | P | 3.6 | OBD-I |
| 5 | R | G | 3.2 | OBD-I |
| 5 | R | L | 2.7 | OBD-I |
| 6 | I | A | 3.3 | OBD-I |
| 6 | — | G | 3.7 | OBD-I |
| 7 | N | Q | 3.1 | OBD-I |
| 7 | N | L | 2.7 | OBD-I |
| 7 | N | S | 3.7 | OBD-I |
| 8 | K | G | 3.3 | OBD-I |
| 15 | K | F | 3.0 | OBD-I |
| 16 | D | W | 2.8 | OBD-I |
| 16 | — | F | 4.2 | OBD-I |
| 18 | — | F | 3.5 | OBD-I |
| 28 | M | H | 2.5 | OBD-I |
| 33 | V | T | 2.0 | OBD-I |
| 34 | R | P | 3.6 | OBD-I |
| 36 | M | Y | 2.4 | OBD-I |
| 41 | R | P | 2.2 | OBD-I |
| 47 | L | P | 2.2 | OBD-I |
| 52 | E | P | 3.2 | OBD-I |
| 55 | — | P | 2.7 | OBD-I |

TABLE 101-continued

Mutations to CasX 515 (SEQ ID NO: 196) systematically identified from all datasets to improve cleavage activity at ATC and CTC PAM sequences

| Position | Reference | Alternate | Maximum observed log$_2$ enrichment in CcdB selections | Domain |
| --- | --- | --- | --- | --- |
| 55 | PQ | — | 3.0 | OBD-I |
| 56 | Q | S | 1.9 | OBD-I |
| 56 | — | D | 2.5 | OBD-I |
| 56 | — | T | 2.8 | OBD-I |
| 56 | Q | P | 3.9 | OBD-I |
| 58 | — | A | 2.2 | helical I-I |
| 63 | R | S | 3.0 | helical I-I |
| 63 | R | Q | 2.7 | helical I-I |
| 72 | D | E | 2.7 | helical I-I |
| 81 | L | V | 2.8 | helical I-I |
| 81 | L | T | 2.7 | helical I-I |
| 85 | W | G | 3.2 | helical I-I |
| 85 | W | F | 2.7 | helical I-I |
| 85 | W | E | 2.9 | helical I-I |
| 85 | W | D | 3.1 | helical I-I |
| 85 | W | A | 2.8 | helical I-I |
| 85 | W | Q | 3.0 | helical I-I |
| 85 | W | R | 3.7 | helical I-I |
| 88 | F | M | 2.4 | helical I-I |
| 89 | Q | D | 2.5 | helical I-I |
| 93 | V | L | 1.9 | helical I-I |
| 109 | Q | P | 1.8 | NTSB |
| 115 | E | S | 1.8 | NTSB |
| 120 | G | D | 2.4 | NTSB |
| 133 | G | T | 2.2 | NTSB |
| 141 | L | A | 2.2 | NTSB |
| 168 | L | K | 3.1 | NTSB |
| 170 | A | Y | 2.7 | NTSB |
| 170 | A | S | 1.7 | NTSB |
| 175 | E | A | 2.0 | NTSB |
| 175 | E | D | 2.8 | NTSB |
| 175 | E | P | 3.8 | NTSB |
| 223 | G | — | 1.4 | helical I-II |
| 223 | G | S | 8.8 | helical I-II |
| 223 | G | T | 3.7 | helical I-II |
| 242 | S | T | 1.9 | helical I-II |
| 247 | I | T | 1.8 | helical I-II |
| 254 | V | T | 2.5 | helical I-II |
| 265 | L | Y | 1.9 | helical I-II |
| 288 | K | G | 4.2 | helical I-II |
| 288 | K | S | 4.0 | helical I-II |
| 291 | V | L | 2.6 | helical I-II |
| 303 | M | T | 2.3 | helical I-II |
| 303 | M | W | 2.7 | helical I-II |
| 328 | G | N | 3.3 | helical I-II |
| 331 | S | Q | 2.7 | helical I-II |
| 334 | — | A | 2.3 | helical II |
| 334 | LV | — | 3.0 | helical II |
| 335 | V | E | 2.8 | helical II |
| 335 | V | Q | 2.7 | helical II |
| 335 | V | F | 2.5 | helical II |
| 335 | V | — | 3.2 | helical II |
| 336 | E | P | 2.9 | helical II |
| 336 | E | — | 3.1 | helical II |
| 336 | E | D | 2.7 | helical II |
| 336 | E | L | 2.4 | helical II |
| 336 | E | R | 2.7 | helical II |
| 337 | R | N | 2.5 | helical II |
| 338 | Q | V | 2.5 | helical II |
| 338 | — | Q | 3.0 | helical II |
| 339 | — | G | 2.6 | helical II |
| 341 | — | H | 2.9 | helical II |
| 341 | — | A | 2.0 | helical II |
| 342 | V | D | 2.7 | helical II |
| 342 | — | T | 2.3 | helical II |
| 342 | V | — | 3.0 | helical II |
| 342 | — | F | 2.5 | helical II |
| 343 | — | D | 3.3 | helical II |
| 343 | D | — | 2.0 | helical II |
| 344 | W | — | 3.1 | helical II |
| 344 | W | T | 2.8 | helical II |
| 344 | W | H | 2.8 | helical II |

TABLE 101-continued

Mutations to CasX 515 (SEQ ID NO: 196) systematically identified from all datasets to improve cleavage activity at ATC and CTC PAM sequences

| Position | Reference | Alternate | Maximum observed log₂ enrichment in CcdB selections | Domain |
|---|---|---|---|---|
| 344 | — | P | 3.0 | helical II |
| 344 | — | G | 2.6 | helical II |
| 345 | — | R | 3.2 | helical II |
| 345 | W | P | 3.1 | helical II |
| 345 | W | D | 2.3 | helical II |
| 345 | — | D | 2.9 | helical II |
| 345 | W | L | 2.3 | helical II |
| 346 | — | P | 2.4 | helical II |
| 346 | — | D | 2.9 | helical II |
| 347 | M | — | 2.6 | helical II |
| 348 | — | T | 3.3 | helical II |
| 350 | N | I | 2.3 | helical II |
| 351 | V | N | 2.8 | helical II |
| 351 | V | H | 3.1 | helical II |
| 352 | K | D | 2.2 | helical II |
| 354 | L | D | 3.1 | helical II |
| 355 | I | S | 2.6 | helical II |
| 357 | E | C | 2.1 | helical II |
| 357 | E | P | 2.8 | helical II |
| 358 | K | T | 2.8 | helical II |
| 359 | K | E | 2.7 | helical II |
| 363 | K | L | 3.3 | helical II |
| 363 | K | Y | 2.2 | helical II |
| 367 | Q | D | 2.8 | helical II |
| 367 | Q | P | 3.0 | helical II |
| 369 | — | S | 2.6 | helical II |
| 369 | LA | — | 2.4 | helical II |
| 373 | K | L | 2.2 | helical II |
| 374 | — | R | 2.0 | helical II |
| 397 | Y | T | 2.5 | helical II |
| 400 | G | M | 2.0 | helical II |
| 402 | L | V | 2.4 | helical II |
| 403 | L | C | 2.3 | helical II |
| 404 | L | D | 2.5 | helical II |
| 404 | L | N | 2.5 | helical II |
| 404 | L | W | 2.3 | helical II |
| 404 | L | Y | 2.1 | helical II |
| 407 | E | F | 2.6 | helical II |
| 407 | E | L | 2.2 | helical II |
| 407 | E | Y | 2.6 | helical II |
| 411 | G | P | 2.6 | helical II |
| 411 | — | E | 3.2 | helical II |
| 413 | — | T | 2.7 | helical II |
| 413 | — | R | 2.4 | helical II |
| 413 | — | W | 3.0 | helical II |
| 413 | — | Y | 3.7 | helical II |
| 414 | — | W | 2.6 | helical II |
| 414 | — | Y | 3.1 | helical II |
| 414 | W | G | 3.0 | helical II |
| 414 | W | R | 2.6 | helical II |
| 416 | K | D | 2.7 | helical II |
| 416 | K | H | 2.0 | helical II |
| 416 | K | P | 2.6 | helical II |
| 416 | K | T | 2.3 | helical II |
| 417 | V | L | 2.6 | helical II |
| 417 | V | A | 2.5 | helical II |
| 418 | Y | C | 2.7 | helical II |
| 419 | D | G | 3.2 | helical II |
| 419 | D | M | 2.4 | helical II |
| 419 | D | P | 2.4 | helical II |
| 425 | I | C | 2.2 | helical II |
| 427 | K | T | 2.4 | helical II |
| 428 | K | R | 2.5 | helical II |
| 430 | E | G | 1.9 | helical II |
| 432 | L | A | 1.9 | helical II |
| 434 | K | H | 2.2 | helical II |
| 436 | I | T | 2.4 | helical II |
| 436 | I | S | 3.0 | helical II |
| 436 | I | Q | 2.7 | helical II |
| 437 | K | D | 3.1 | helical II |
| 442 | R | D | 2.5 | helical II |
| 442 | R | — | 2.7 | helical II |
| 446 | D | E | 2.3 | helical II |
| 446 | — | D | 2.3 | helical II |
| 450 | K | P | 2.3 | helical II |
| 452 | A | R | 2.0 | helical II |
| 453 | L | T | 3.2 | helical II |
| 456 | W | L | 2.2 | helical II |
| 457 | L | C | 2.2 | helical II |
| 459 | A | L | 2.0 | helical II |
| 461 | A | T | 2.7 | helical II |
| 461 | A | K | 2.1 | helical II |
| 465 | I | E | 3.1 | helical II |
| 465 | — | C | 2.9 | helical II |
| 466 | — | S | 3.5 | helical II |
| 466 | — | G | 2.5 | helical II |
| 467 | — | R | 2.4 | helical II |
| 467 | G | P | 2.0 | helical II |
| 468 | L | K | 3.6 | helical II |
| 468 | L | D | 3.2 | helical II |
| 468 | L | S | 3.0 | helical II |
| 468 | L | H | 3.3 | helical II |
| 470 | E | — | 2.4 | helical II |
| 472 | D | R | 2.2 | helical II |
| 472 | — | D | 2.4 | helical II |
| 473 | — | P | 2.6 | helical II |
| 474 | — | D | 2.7 | helical II |
| 475 | EF | — | 2.8 | helical II |
| 475 | — | Q | 2.7 | helical II |
| 476 | F | K | 2.8 | helical II |
| 476 | F | — | 2.2 | helical II |
| 477 | — | G | 2.8 | helical II |
| 479 | C | D | 3.1 | helical II |
| 480 | — | V | 2.2 | helical II |
| 480 | E | D | 2.3 | helical II |
| 481 | — | H | 2.2 | helical II |
| 481 | L | R | 2.9 | helical II |
| 482 | K | R | 2.1 | helical II |
| 483 | L | H | 2.7 | helical II |
| 484 | Q | C | 2.1 | helical II |
| 485 | K | P | 3.0 | helical II |
| 490 | L | S | 2.8 | helical II |
| 498 | E | L | 2.1 | helical II |
| 499 | — | F | 1.6 | helical II |
| 511 | K | T | 6.8 | OBD-II |
| 524 | — | P | 2.4 | OBD-II |
| 553 | — | S | 2.4 | OBD-II |
| 558 | — | R | 1.9 | OBD-II |
| 570 | M | T | 2.7 | OBD-II |
| 582 | I | T | 1.9 | OBD-II |
| 592 | Q | I | 2.1 | OBD-II |
| 592 | Q | F | 2.8 | OBD-II |
| 592 | Q | V | 2.0 | OBD-II |
| 592 | Q | A | 2.9 | OBD-II |
| 641 | — | R | 2.3 | OBD-II |
| 643 | — | D | 2.7 | OBD-II |
| 644 | — | W | 2.5 | OBD-II |
| 645 | — | A | 2.4 | OBD-II |
| 650 | — | I | 2.5 | RuvC-I |
| 651 | — | S | 2.4 | RuvC-I |
| 652 | — | T | 2.4 | RuvC-I |
| 652 | — | N | 2.3 | RuvC-I |
| 653 | — | R | 2.3 | RuvC-I |
| 653 | — | K | 2.2 | RuvC-I |
| 654 | — | H | 2.2 | RuvC-I |
| 654 | — | S | 2.3 | RuvC-I |
| 658 | V | L | 1.9 | RuvC-I |
| 695 | G | W | 1.4 | RuvC-I |
| 695 | G | R | 3.5 | RuvC-I |
| 708 | K | S | 3.0 | RuvC-I |
| 708 | K | T | 2.9 | RuvC-I |
| 708 | K | E | 3.1 | RuvC-I |
| 711 | V | A | 1.6 | RuvC-I |
| 726 | K | E | 2.0 | RuvC-I |

TABLE 101-continued

Mutations to CasX 515 (SEQ ID NO: 196) systematically identified from all datasets to improve cleavage activity at ATC and CTC PAM sequences

| Position | Reference | Alternate | Maximum observed log₂ enrichment in CcdB selections | Domain |
|---|---|---|---|---|
| 729 | N | G | 2.8 | RuvC-I |
| 736 | R | H | 2.7 | RuvC-I |
| 736 | R | G | 2.4 | RuvC-I |
| 771 | M | S | 3.7 | RuvC-I |
| 771 | M | A | 3.3 | RuvC-I |
| 792 | L | F | 2.5 | RuvC-I |
| 868 | V | D | 1.9 | TSL |
| 877 | — | A | 2.0 | TSL |
| 886 | T | E | 1.8 | TSL |
| 886 | T | D | 2.5 | TSL |
| 886 | T | N | 1.6 | TSL |
| 888 | G | D | 2.5 | TSL |
| 890 | S | — | 3.0 | TSL |
| 891 | G | — | 2.7 | TSL |
| 892 | — | E | 2.0 | TSL |
| 892 | — | N | 2.9 | TSL |
| 895 | S | I | 1.7 | TSL |
| 908 | E | D | 1.7 | TSL |
| 932 | S | M | 2.5 | RuvC-II |
| 932 | S | V | 2.6 | RuvC-II |
| 944 | — | L | 1.4 | RuvC-II |
| 947 | — | G | 1.9 | RuvC-II |
| 949 | T | — | 1.9 | RuvC-II |
| 951 | G | I | 3.7 | RuvC-II |

TABLE 102

Mutations to CasX 515 (SEQ ID NO: 196) systematically identified from all datasets to improve spacer specificity

| Position | Reference | Alternate | Maximum observed log₂ enrichment in counter-selections | Domain |
|---|---|---|---|---|
| 6 | I | L | 2.25 | OBD-I |
| 48 | — | P | 2 | OBD-I |
| 87 | — | G | 3.96 | helical I-I |
| 90 | K | V | 4.84 | helical I-I |
| 155 | F | V | 2.13 | NTSB |
| 215 | — | T | 2.03 | helical I-II |
| 216 | — | C | 3.03 | helical I-II |
| 220 | Y | F | 2.1 | helical I-II |
| 264 | S | H | 3.16 | helical I-II |
| 329 | — | Q | 2.71 | helical I-II |
| 343 | D | S | 2.69 | helical II |
| 346 | DM | — | 2.96 | helical II |
| 349 | — | P | 2.06 | helical II |
| 357 | — | G | 2.11 | helical II |
| 375 | QE | — | 2.34 | helical II |
| 378 | L | N | 2.38 | helical II |
| 389 | K | Q | 2.29 | helical II |
| 417 | — | L | 2.75 | helical II |
| 441 | E | L | 2.36 | helical II |
| 458 | R | D | 2.2 | helical II |
| 459 | A | E | 2.65 | helical II |
| 476 | FC | — | 2.34 | helical II |
| 503 | IL | — | 2.15 | OBD-II |
| 537 | K | G | 2.85 | OBD-II |
| 621 | L | T | 2.45 | OBD-II |
| 624 | — | A | 3 | OBD-II |
| 783 | L | Y | 2.08 | RuvC-I |
| 783 | — | P | 2.6 | RuvC-I |
| 787 | L | — | 2.49 | RuvC-I |
| 787 | L | R | 3.58 | RuvC-I |
| 787 | L | D | 5.58 | RuvC-I |
| 788 | — | Q | 2.65 | RuvC-I |
| 789 | — | R | 2.5 | RuvC-I |
| 789 | — | N | 2.71 | RuvC-I |
| 790 | E | N | 2.45 | RuvC-I |

TABLE 102-continued

Mutations to CasX 515 (SEQ ID NO: 196) systematically identified from all datasets to improve spacer specificity

| Position | Reference | Alternate | Maximum observed log₂ enrichment in counter-selections | Domain |
|---|---|---|---|---|
| 792 | — | P | 2.85 | RuvC-I |
| 793 | P | A | 2.93 | RuvC-I |
| 795 | K | Q | 2.45 | RuvC-I |
| 796 | T | V | 2.75 | RuvC-I |
| 798 | — | R | 4.07 | RuvC-I |
| 799 | — | H | 2.79 | RuvC-I |
| 801 | T | Q | 3.16 | RuvC-I |
| 801 | — | H | 3.34 | RuvC-I |
| 801 | — | R | 2.86 | RuvC-I |
| 802 | — | L | 2.88 | RuvC-I |
| 802 | L | — | 2.87 | RuvC-I |
| 802 | — | W | 3.08 | RuvC-I |
| 803 | — | A | 3.19 | RuvC-I |
| 803 | — | F | 3.14 | RuvC-I |
| 803 | A | S | 5.79 | RuvC-I |
| 804 | Q | K | 3.05 | RuvC-I |
| 805 | Y | — | 3.29 | RuvC-I |
| 806 | T | Y | 3.07 | RuvC-I |
| 806 | T | F | 2.49 | RuvC-I |
| 807 | — | I | 3.21 | RuvC-I |
| 807 | S | P | 2.61 | RuvC-I |
| 809 | T | P | 3.2 | RuvC-I |
| 809 | — | N | 3.1 | RuvC-I |
| 810 | C | K | 3.19 | RuvC-I |
| 810 | C | M | 3.08 | RuvC-I |
| 811 | — | M | 2.51 | TSL |
| 812 | N | — | 3.07 | TSL |
| 812 | — | V | 2.68 | TSL |
| 813 | C | S | 2.3 | TSL |
| 814 | — | G | 3.15 | TSL |
| 814 | — | W | 3.04 | TSL |
| 815 | F | P | 3.09 | TSL |
| 817 | — | W | 2.87 | TSL |
| 828 | K | G | 1.99 | TSL |
| 906 | V | C | 2.01 | TSL |

TABLE 103

Mutations to CasX 515 (SEQ ID NO: 196) systematically identified from all datasets to improve cleavage activity at TTC PAM sequences

| Position | Reference | Alternate | Maximum observed log₂ enrichment in Ccdb selections | Domain |
|---|---|---|---|---|
| 4 | K | W | 3.51 | OBD-I |
| 5 | R | P | 4.01 | OBD-I |
| 27 | — | P | 4.69 | OBD-I |
| 28 | M | P | 3.69 | OBD-I |
| 56 | Q | P | 3.78 | OBD-I |
| 85 | W | A | 3.96 | helical I-I |
| 102 | — | G | 4.75 | NTSB |
| 104 | — | I | 4.43 | NTSB |
| 104 | — | L | 4.52 | NTSB |
| 130 | S | — | 4.02 | NTSB |
| 151 | Y | T | 3.46 | NTSB |
| 168 | L | D | 3.32 | NTSB |
| 168 | L | E | 4.08 | NTSB |
| 188 | K | Q | 4.96 | NTSB |
| 190 | G | Q | 4.1 | NTSB |
| 223 | G | — | 1.63 | helical I-II |
| 235 | G | L | 4.64 | helical I-II |
| 235 | G | H | 4.97 | helical I-II |
| 239 | S | H | 3.93 | helical I-II |
| 239 | S | T | 4.97 | helical I-II |
| 245 | Q | H | 5 | helical I-II |
| 288 | K | D | 5.08 | helical I-II |
| 288 | K | E | 4.79 | helical I-II |
| 303 | M | R | 3.71 | helical I-II |

TABLE 103-continued

Mutations to CasX 515 (SEQ ID NO: 196) systematically identified from all datasets to improve cleavage activity at TTC PAM sequences

| Position | Reference | Alternate | Maximum observed log₂ enrichment in Ccdb selections | Domain |
|---|---|---|---|---|
| 303 | M | K | 3.29 | helical I-II |
| 307 | L | K | 3.55 | helical I-II |
| 328 | G | R | 3.91 | helical I-II |
| 328 | G | K | 4.58 | helical I-II |
| 334 | — | H | 5.65 | helical II |
| 335 | — | D | 5.5 | helical II |
| 335 | V | P | 5.1 | helical II |
| 345 | — | Q | 5.22 | helical II |
| 441 | — | K | 5.07 | helical II |
| 477 | C | R | 2.94 | helical II |
| 477 | C | K | 3.49 | helical II |
| 502 | S | — | 4.04 | OBD-II |
| 503 | I | R | 3.72 | OBD-II |
| 503 | I | K | Not detected | OBD-II |
| 504 | L | — | 4.24 | OBD-II |
| 542 | R | E | 4.54 | OBD-II |
| 563 | K | — | 3.25 | OBD-II |
| 593 | — | A | 1.83 | OBD-II |
| 610 | K | Q | 3.46 | OBD-II |
| 615 | R | Q | 3.67 | OBD-II |
| 643 | — | A | 2.42 | OBD-II |
| 697 | S | R | 2.67 | RuvC-I |
| 697 | S | K | 2.55 | RuvC-I |
| 906 | V | T | 4.65 | TSL |

Example 38: Generation of Exemplary Version 206 XDPs

Experiments will be conducted to generate exemplary version 206 XDPs.

Methods:

Plasmid Cloning

Plasmids encoding CasX proteins will encode the CasX 491 variant protein or the CasX 676 variant protein. Guide scaffold 174 or guide scaffold 235 will be used. Structural plasmids, guide plasmids, and pGP2 glycoprotein plasmids will be cloned as described in Example 7, above. Exemplary DNA sequences of version 206 components are provided in Table 104.

TABLE 104

DNA sequences of components of version 206 XDPs

| XDP version 206 plasmid | XDP version 206 Encoded Components ** | DNA Sequence of Encoded Components (5'-3') | SEQ ID NO |
|---|---|---|---|
| 1 | MA*-CA*-NC*-p1*-p6-MS2 | ATGGGTGCGAGAGCGTCAGTATTAAGCGGGGGAGAATTAGATCGATG GGAAAAAATTCGGTTAAGGCCAGGGGGAAAGAAAAAATATAAATTAA AACATATAGTATGGGCAAGCAGGGAGCTAGAACGATTCGCAGTTAAT CCTGGCCTGTTAGAAACATCAGAAGGCTGTAGACAAATACTGGGACA GCTACAACCATCCCTTCAGACAGGATCAGAAGAACTTAGATCATTAT ATAATACAGTAGCAACCCTCTATTGTGTGCATCAAAGGATAGAGATA AAAGACACCAAGGAAGCTTTAGACAAGATAGAGGAAGAGCAAAACAA AAGTAAGAAAAAAGCACAGCAAGCAGCAGCTGACACAGGACACAGCA ATCAGGTCAGCCAAAATTACCCTATAGTGCAGAACATCCAGGGGCAA ATGGTACATCAGGCCATATCACCTAGAACTTTAAATGCATGGGTAAA AGTAGTAGAAGAGAAGGCTTTCAGCCCAGAAGTGATACCCATGTTTT CAGCATTATCAGAAGGAGCCACCCCACAAGATTTAAACACCATGCTA AACACAGTGGGGGGACATCAAGCAGCCATGCAAATGTTAAAAGAGAC CATCAATGAGGAAGCTGCAGAATGGGATAGAGTGCATCCAGTGCATG CAGGGCCTATTGCACCAGGCCAGATGAGAGAACCAAGGGGAAGTGAC ATAGCAGGAACTACTAGTACCCTTCAGGAACAAATAGGATGGATGAC ACATAATCCACCTATCCCAGTAGGAGAAATCTATAAAGATGGATAA TCCTGGGATTAAATAAAATAGTAAGAATGTATAGCCCTACCAGCATT CTGGACATAAGACAAGGACCAAAGGAACCCTTTAGAGACTATGTAGA CCGATTCTATAAAACTCTAAGAGCCGAGCAAGCTTCACAAGAGGTAA AAAATTGGATGACAGAAACCTTGTTGGTCCAAAATGCGAAC C C AGAT TGTAAGACTATTTTAAAAGCATTGGGACCAGGAGCGACACTAGAAGA | 35164 |
| XDP version 206 plasmid | XDP version 206 Encoded Components ** | DNA Sequence of Encoded Components (5'-3')<br>AATGATGACAGCATGTCAGGGAGTGGGGGGACCCGGCCATAAAGCAA GAGTTTTGGCTGAAGCAATGAGCCAAGTAACAAATCCAGCTACCATA ATGATACAGAAAGGCAATTTTAGGAACCAAAGAAAGACTGTTAAGTG TTTCAATTGTGGCAAAGAAGGGCACATAGCCAAAAATTGCAGGGCCC CTAGGAAAAAGGGCTGTTGGAAATGTGGAAAGGAAGGACACCAAATG AAAGATTGTACTGAGAGACAGGCTAATTTTTTAGGGAAGATCTGGCC TTCCCACAAGGGAAGGCCAGGGAATTTTCTTCAGAGCAGACCAGAGC CAACAGCCCCACCAGAAGAGAGCTTCAGGTTTGGGGAAGAGACAACA ACTCCCTCTCAGAAGCAGGAGCCGATAGACAAGGAACTGTATCCTTT AGCTTCCCTCAGATCACTCTTTGGCAGCGACCCCTCGTCACAAATGG CGTCAAACTTCACGCAGTTTGTCCTCGTTGACAACGGGGGACTGGC GATGTCACAGTGGCTCCCAGTAACTTCGCGAATGGCGTCGCCGAATG GATCAGCAGTAACTCTCGGTCTCAGGCATACAAGGTCACCTGTTCCG TGCGCCAATCATCTGCCCAGAACAGGAAATACACCATTAAGGTGGAG GTGCCAAAGGTCGCCACCCAGACTGTGGGAGGGGTGGAGCTGCCTGT | SEQ ID NO |

TABLE 104-continued

| | | | |
|---|---|---|---|
| 2 | MA*-CA*-NC*-p1*-p6*-Prot | GGCCGCCTGGAGGTCATACCTCAACATGGAGCTCACCATACCTATAT<br>TCGCAACCAATTCCGACTGCGAATTGATCGTCAAAGCGATGCAGGGC<br>CTCCTGAAGGATGGTAACCCAATTCCGAGTGCAATCGCAGCTAACAG<br>CGGCATTTACTTATAA<br>ATGGGTGCGAGAGCGTCAGTATTAAGCGGGGGAGAATTAGATCGATG<br>GGAAAAAATTCGGTTAAGGCCAGGGGGAAAGAAAAAATATAAATTAA<br>AACATATAGTATGGGCAAGCAGGGAGCTAGAACGATTCGCAGTTAAT<br>CCTGGCCTGTTAGAAACATCAGAAGGCTGTAGACAAATACTGGGACA<br>GCTACAACCATCCCTTCAGACAGGATCAGAAGAACTTAGATCATTAT<br>ATAATACAGTAGCAACCCTCTATTGTGTGCATCAAAGGATAGAGATA<br>AAAGACACCAAGGAAGCTTTAGACAAGATAGAGGAAGAGCAAAACAA<br>AAGTAAGAAAAAAGCACAGCAAGCAGCAGCTGACACAGGACACAGCA<br>ATCAGGTCAGCCAAAATTACCCTATAGTGCAGAACATCCAGGGGCAA<br>ATGGTACATCAGGCCATATCACCTAGAACTTTAAATGCATGGGTAAA<br>AGTAGTAGAAGAGAAGGCTTTCAGCCCAGAAGTGATACCCATGTTTT<br>CAGCATTATCAGAAGGAGCCACCCCACAAGATTTAAACACCATGCTA<br>AACACAGTGGGGGACATCAAGCAGCCATGCAAATGTTAAAAGAGAC<br>CATCAATGAGGAAGCTGCAGAATGGGATAGAGTGCATCCAGTGCATG<br>CAGGGCCTATTGCACCAGGCCAGATGAGAGAACCAAGGGGAAGTGAC<br>ATAGCAGGAACTACTAGTACCCTTCAGGAACAAATAGGATGGATGAC<br>ACATAATCCACCTATCCCAGTAGGAGAAATCTATAAAAGATGGATAA<br>TCCTGGGATTAAATAAAATAGTAAGAATGTATAGCCCTACCAGCATT<br>CTGGACATAAGACAAGGACCAAAGGAACCCTTTAGAGACTATGTAGA<br>CCGATTCTATAAAACTCTAAGAGCCGAGCAAGCTTCACAAGAGGTAA<br>AAAATTGGATGAC AGAAAC CTTGTTGGTC CAAAATGCGAAC C C AGAT<br>TGTAAGACTATTTTAAAAGCATTGGGACCAGGAGCGACACTAGAAGA<br>AATGATGACAGCATGTCAGGGAGTGGGGGGACCCGGCCATAAAGCAA<br>GAGTTTTGGCTGAAGCAATGAGCCAAGTAACAAATCCAGCTACCATA<br>ATGATACAGAAAGGCAATTTTAGGAACCAAAGAAAGACTGTTAAGTG<br>TTTCAATTGTGGCAAAGAAGGGCACATAGCCAAAAATTGCAGGGCCC<br>CTAGGAAAAAGGGCTGTTGGAAATGTGGAAAGGAAGGACACCAAATG<br>AAAGATTGTACTGAGAGACAGGCTAATTTTTTAGGGAAGATCTGGCC<br>TTCCCACAAGGGAAGGCCAGGGAATTTTCTTCAGAGCAGACCAGAGC | 35165 |
| XDP version 206 plasmid | XDP version 206 Encoded Components ** | DNA Sequence of Encoded Components (5'-3') | SEQ ID NO |
| | | CAACAGCCCCACCAGAAGAGAGCTTCAGGTTTGGGGAAGAGACAACA<br>ACTCCCTCTCAGAAGCAGGAGCCGATAGACAAGGAACTGTATCCTTT<br>AGCTTCCCTCAGATCACTCTTTGGCAGCGACCCCTCGTCACAATAAA<br>GATAGGGGGGCAATTAAAGGAAGCTCTATTAGATACAGGAGCAGATG<br>ATACAGTATTAGAAGAAATGAATTTGCCAGGAAGATGGAAACCAAAA<br>ATGATAGGGGGAATTGGAGGTTTTATCAAAGTAAGACAGTATGATCA<br>GATACTCATAGAAATCTGCGGACATAAAGCTATAGGTACAGTATTAG<br>TAGGACCTACACCTGTCAACATAATTGGAAGAAATCTGTTGACTCAG<br>ATTGGCTGCACTTTAA | |
| 3 | CasX-491 | CAAGAGATCAAGAGAATCAACAAGATCAGAAGGAGACTGGTCAAGGA<br>CAGCAACACAAAGAAGGCCGGCAAGACAGGCCCCATGAAAACCCTGC<br>TCGTCAGAGTGATGACCCCTGACCTGAGAGAGCGGCTGGAAAACCTG<br>AGAAAGAAGCCCGAGAACATCCCTCAGCCTATCAGCAACACCAGCAG<br>GGCCAACCTGAACAAGCTGCTGACCGACTACACCGAGATGAAGAAAG<br>CCATCCTGCACGTGTACTGGGAAGAGTTCCAGAAAGACCCCGTGGGC<br>CTGATGAGCAGAGTTGCTCAGCCTGCCAGCAAGAAGATCGACCAGAA<br>CAAGCTGAAGCCCGAGATGGACGAGAAGGGCAATCTGACCACAGCCG<br>GCTTTGCCTGCTCTCAGTGTGGCCAGCCTCTGTTCGTGTACAAGCTG<br>GAACAGGTGTCCGAGAAAGGCAAGGCCTACACCAACTACTTCGGCAG<br>ATGTAACGTGGCCGAGCACGAGAAGCTGATTCTGCTGGCCCAGCTGA<br>AACCTGAGAAGGACTCTGATGAGGCCGTGACCTACAGCCTGGGCAAG<br>TTTGGACAGAGAGCCCTGGACTTCTACAGCATCCACGTGACCAAAGA<br>AAGCACACACCCCGTGAAGCCCCTGGCTCAGATCGCCGGCAATAGAT<br>ACGCCTCTGGACCTGTGGGCAAAGCCCTGTCCGATGCCTGCATGGGA<br>ACAATCGCCAGCTTCCTGAGCAAGTACCAGGACATCATCATCGAGCA<br>CCAGAAGGTGGTCAAGGGCAACCAGAAGAGACTGGAAAGCCTGAGGG<br>AGCTGGCCGGCAAAGAGAACCTGGAATACCCCAGCGTGACCCTGCCT<br>CCTCAGCCTCACACAAAAGAAGGCGTGGACGCCTACAACGAAGTGAT<br>CGCCAGAGTGAGAATGTGGGTCAACCTGAACCTGTGGCAGAAGCTGA<br>AACTGTCCAGGGACGACGCCAAGCCTCTGCTGAGACTGAAGGGCTTC<br>CCTAGCTTCCCTCTGGTGGAAAGACAGGCCAATGAAGTGGATTGGTG<br>GGACATGGTCTGCAACGTGAAGAAGCTGATCAACGAGAAGAAAGAGG<br>ATGGCAAGGTTTTCTGGCAGAACCTGGCCGGCTACAAGAGACAAGAA<br>GCCCTGAGGCCTTACCTGAGCAGCGAAGAGGACCGGAAGAAGGGCAA<br>GAAGTTCGCCAGATACCAGCTGGGCGACCTGCTGCTGCACCTGGAAA<br>AGAAGCACGGCGAGGACTGGGCAAAGTGTACGATGAGGCCTGGGAG<br>AGAATCGACAAGAAGGTGGAAGGCCTGAGCAAGCACATTAAGCTGGA<br>AGAGGAAAGAAGGGAGCGAGGACGCCCAATCTAAAGCCGCTCTGACCC<br>ATTGGCTGAGAGCCAAGGCCAGCTTTGTGATCGAGGGCCTGAAAGAG<br>GCCGACAAGGACGAGTTCTGCAGATGCGAGCTGAAGCTGCAGAAGTG<br>GTACGGCGATCTGAGAGGCAAGCCCTTCGCCATTGAGGCCGAGAACA<br>GCATCCTGGACATCAGCGGCTTCAGCAAGCAGTACAACTGCGCCTTC<br>ATTTGGCAGAAAGACGGCGTCAAGAAACTGAACCTGTACCTGATCAT | 35166 |

TABLE 104-continued

| XDP version 206 plasmid ** | XDP version 206 Encoded Components | DNA Sequence of Encoded Components (5'-3') | SEQ ID NO |
|---|---|---|---|
| | | CAATTACTTCAAAGGCGGCAAGCTGCGGTTCAAGAAGATCAAACCCG AGGCCTTCGAGGCTAACAGATTCTACACCGTGATCAACAAAAAGTCC GGCGAGATCGTGCCCATGGAAGTGAACTTCAACTTCGACGACCCCAA CCTGATTATCCTGCCTCTGGCCTTCGGCAAGAGACAGGGCAGAGAGT TCATCTGGAACGATCTGCTGAGCCTGGAAACCGGCTCTCTGAAGCTG | |
| | | GCCAATGGCAGAGTGATCGAGAAACCCTGTACAACAGGAGAACCAG ACAGGACGAGCCTGCTCTGTTTGTGGCCCTGACCTTCGAGAGAAGAG AGGTGCTGGACAGCAGCAACATCAAGCCCATGAACCTGATCGGCGTG GACCGGGGCGAGAATATCCCTGCTGTGATCGCCCTGACAGACCCTGA AGGATGCCCACTGAGCAGATTCAAGGACTCCCTGGGCAACCCTACAC ACATCCTGAGAATCGGCGAGAGCTACAAAGAGAAGCAGAGGACAATC CAGGCCAAGAAAGAGGTGGAACAGCGCAGAGCCGGCGGATACTCTAG GAAGTACGCCAGCAAGGCCAAGAATCTGGCCGACGACATGGTCCGAA ACACCGCCAGAGATCTGCTGTACTACGCCGTGACACAGGACGCCATG CTGATCTTCGAGAATCTGAGCAGAGGCTTCGGCCGGCAGGGCAAGAG AACCTTTATGGCCGAGAGGCAGTACACCAGAATGGAAGATTGGCTCA CAGCTAAACTGGCCTACGAGGGACTGAGCAAGACCTACCTGTCCAAA ACACTGGCCCAGTATACCTCCAAGACCTGCAGCAATTGCGGCTTCAC CATCACCAGCGCCGACTACGACAGAGTGCTGGAAAAGCTCAAGAAAA CCGCCACCGGCTGGATGACCACCATCAACGGCAAAGAGCTGAAGGTT GAGGGCCAGATCACCTACTACAACAGGTACAAGAGGCAGAACGTCGT GAAGGATCTGAGCGTGGAACTGGACAGACTGAGCGAAGAGAGCGTGA ACAACGACATCAGCAGCTGGACAAAGGGCAGATCAGGCGAGGCTCTG AGCCTGCTGAAGAAGAGGGTTTAGCCACAGACCTGTGCAAGAGAAGTT CGTGTGCCTGAACTGCGGCTTCGAGACACACGCCGATGAACAGGCTG CCCTGAACATTGCCAGAAGCTGGCTGTTCCTGAGAAGCCAAGAGTAC AAGAAGTAC C AGAC CAACAAGAC C AC CGGCAAC AC CGACAAGAGGGC CTTTGTGGAAACCTGGCAGAGCTTCTACAGAAAAAAGCTGAAAGAAG TCTGGAAGCCCGCCGTG | |
| 3 | CasX - 676 | CAAGAGATCAAGAGAATCAACAAGATCAGAAGGAGACTGGTCAAGGA CAGCAACACAAAGAAGGCCGGCAAGCACGGGGCC C C ATGAAAAC C C TGCTCGTCAGAGTGATGACCCCTGACCTGAGAGAGCGGCTGGAAAAC CTGAGAAAGAAGCCCGAGAACATCCCTCAGCCTATCAGCAACACCAG CAGGGCCAACCTGAACAAGCTGCTGACCGACTACACCGAGATGAAGA AGCCATCCTGCACGTGTACTGGGAAGAGTTCCAGAAAGACCCCGTG GGCCTGATGAGCAGAGTTGCTCAGCCTGCCAGCAAGAAGATCGACCA GAACAAGCTGAAGCCCGAGATGGACGAGAAGGGCAATCTGACCACAG CCGGCTTTGCCTGCTCTCAGTGTGGCCAGCCTCTGTTCGTGTACAAG CTGGAACAGGTGTCCGAGAAAGGCAAGGCCTACACCAACTACTTCGG CAGATGTAACGTGGCCGAGCACGAGAGCTGATTAAGCTGGCCCAGC TGAAACCTGAGAAGGACTCTGATGAGGCCGTGACCTACAGCCTGGGC AAGTTTGGACAGAGAGCCCTGGACTTCTACAGCATCCACGTGACCAA AGAAAGCACACACCCCGTGAAGCCCCTGGCTCAGATCGCCGGCAATA GATACGCCTCTTCCCCTGTGGGCAAAGCCCTGTCCGATGCCTGCATG GGAACAATCGCCAGCTTCCTGAGCAAGTACCAGGACATCATCATCGA GCACCAGAAGGTGGTCAAGGGCAACCAGAAGAGACTGGAAAGCCTGA GGGAGCTGGCCGGCAAAGAGAACCTGGAATACCCCAGCGTGACCCTG CCTCCTCAGCCTCACACAAAAGAAGGCGTGGACGCCTACAACGAAGT GATCGCCAGAGTGAGAATGTGGGTCAACCTGAACCTGTGGCAGAAGC TGAAACTGTCCAGGGACGACGCCAAGCCTCTGCTGAGACTGAAGGGC TTCCCTAGCTTCCCTCTGGTGG7U\AGACAGGCC7\ATG7\AGTGGATTG GTGGGACATGGTCTGC7\ACGTG7\AG7\AGCTGATC7\ACGAG7\AG7U\AG AGGATGGC7\AGGTTTTCTGGCAG7\ACCTGGCCGGCTAC7\AGAGAC7\A G7\AGCCCTGAGGCCTTACCTGAGCAGCG7\AGAGGACCGG7\AG7\AGGG | 35167 |

| XDP version 206 plasmid ** | XDP version 206 Encoded Components | DNA Sequence of Encoded Components (5'-3') | SEQ ID NO |
|---|---|---|---|
| | | CAAGAAGTTCGCCAGATACCAGCTGGGCGACCTGCTGCTGCACCTGG AAAAGAAGCACGGCGAGGACTGGGGCAAAGTGTACGATGAGGCCTGG GAGAG7\ATCGAC7\AG7\AGGTGG7\AGGCCTGAGC7\AGCACATT7\AGCT GGAAGAGGAAAGAAGGAGCGAGGACGCCCAATCTAAAGCCGCTCTGA CCGATTGGCTGAGAGCCAAGGCCAGCTTTGTGATCGAGGGCCTGAAA GAGGCCGACAAGGACGAGTTCTGCAGATGCGAGCTGAAGCTGCAGAA GTGGTACGGCGATCTGAGAGGCAAGCCCTTCGCCATTGAGGCCGAGA ACAGCATCCTGGACATCAGCGGCTTCAGCAAGCAGTACAACTGCGCC TTCATTTGGCAGAAAGACGGCGTCAAGAAACTGAACCTGTACCTGAT CATCAATTACTTCAAAGGCGGCAAGCTGCGGTTCAAGAAGATCAAAC CCGAGGCCTTCGAGGCTAACAGATTCTACACCGTGATCAACAAAAAG TCCGGCGAGATCGTGCCCATGGAAGTGAACTTCAACTTCGACGACCC CAACCTGATTATCCTGCCTCTGGCCTTCGGCAAGAGACAGGGCAGAG AGTTCATCTGGAACGATCTGCTGAGCCTGGAAACCGGCTCTCTGAAG CTGGCCAATGGCAGAGTGATCGAGAAACCCTGTACAACAGGAGAAC CAGACAGGACGAGCCTGCTCTGTTTGTGGCCCTGACCTTCGAGAGAA GAGAGGTGCTGGACAGCAGCAACATCAAGCCCATGAACCTGATCGGC GTGGACCGGGGCGAGAATATCCCTGCTGTGATCGCCCTGACAGACCC | |

TABLE 104-continued

| | | | |
|---|---|---|---|
| | | TGAAGGATGCCCACTGAGCAGATTCAAGGACTCCCTGGGCAACCCTA<br>CACACATCCTGAGAATCGGCGAGAGCTACAAAGAGAAGCAGAGGACA<br>ATCCAGGCCAAGAAAGAGGTGGAACAGAGAAGAGCCGGCGGATACTC<br>TAGGAAGTACGCCAGCAAGGCCAAGAATCTGGCCGACGACATGGTCC<br>GAAACACCGCCAGAGATCTGCTGTACTACGCCGTGACACAGGACGCC<br>ATGCTGATCTTCGAGAATCTGAGCAGAGGCTTCGGCCGGCAGGGCAA<br>GAGAACCTTTATGGCCGAGAGGCAGTACACCAGAATGGAAGATTGGC<br>TCACAGCTAAACTGGCCTACGAGGGACTGCCCAGCAAGACCTACCTG<br>TCCAAAACACTGGCCCAGTATACCTCCAAGACCTGCAGCAATTGCGG<br>CTTCACCATCACCAGCGCCGACTACGACAGAGTGCTGGAAAAGCTCA<br>AGAAAACCGCCACCGGCTGGATGACCACCATCAACGGCAAAGAGCTG<br>AAGGTTGAGGGCCAGATCACCTACTACAACAGGTACAAGAGGCAGAA<br>CGTCGTGAAGGATCTGAGCGTGGAACTGGACAGACTGAGCGAAGAGA<br>GCGTGAACAACGACATCAGCAGCTGGACAAAGGGCAGATCAGGCGAG<br>GCTCTGAGCCTGCTGAAGAAGAGGTTTAGCCACAGACCTGTGCAAGA<br>GAAGTTCGTGTGCCTGAACTGCGGCTTCGAGACACACGCCGATGAAC<br>AGGCTGCCCTGAACATTGCCGAAGCTGGCTGTTCCTGAGAAGCCAA<br>GAGTACAAGAAGTAC C AGAC CAACAAGAC C AC CGGCAAC AC CGACAA<br>GAGGGCCTTTGTGGAAACCTGGCAGAGCTTCTACAGAAAAAAGCTGA<br>AAGAAGTCTGGAAGCCCGCCGTG | |
| 4 | VSV-G<br>(pGP2)<br>Tropism<br>Factor | ATG7\AGTGCCTTTTGTACTTAGCCTTTTTATTCATTGGGGTG7\ATTG<br>CAAGTTCACCATAGTTTTTCCACACAACCAAAAAGGAAACTGGAAAA<br>ATGTTCCTTCT7\ATTACCATTATTGCCCGTC7\AGCTCAGATTT7U\AT<br>TGGCAT7\ATGACTT7\ATAGGCACAGCCTTAC7\AGTC7W\ATGCCC7\A<br>GAGTCAC7\AGGCTATTC7\AGCAGACGGTTGGATGTGTCATGCTTCCA<br>7\ATGGGTCACTACTTGTGATTTCCGCTGGTATGGACCG7\AGTATATA<br>ACACATTCCATCCGATCCTTCACTCCATCTGTAG7\AC7\ATGC7\AGGA<br>AAGCATTGAACAAACGAAACAAGGAACTTGGCTGAATCCAGGCTTCC<br>CTCCTC7V\AGTTGTGGATATGC7\ACTGTGACGGATGCCG7\AGCAGTG<br>ATTGTCCAGGTGACTCCTCACCATGTGCTGGTTGATG7\ATACACAGG<br>AGAATGGGTTGATTCACAGTTCATCAACGGAAAATGCAGCAATTACA | 35168 |

| XDP version 206 plasmid | XDP version 206 Encoded Components ** | DNA Sequence of Encoded Components (5'-3') | SEQ ID NO |
|---|---|---|---|
| | | TATGCCCCACTGTCCATAACTCTACAACCTGGCATTCTGACTATAAG<br>GTCAAAGGGCTATGTGATTCTAACCTCATTTCCATGGACATCACCTT<br>CTTCTCAGAGGACGGAGAGCTATCATCCCTGGGAAAGGAGGGCACAG<br>GGTTCAGAAGTAACTACTTTGCTTATGAAACTGGAGGCAAGGCCTGC<br>AAAATGCAATACTGCAAGCATTGGGGAGTCAGACTCCCATCAGGTGT<br>CTGGTTCGAGATGGCTGATAAGGATCTCTTTGCTGCAGCCAGATTCC<br>CTGAATGCCCAGAAGGGTCAAGTATCTCTGCTCCATCTCAGACCTCA<br>GTGGATGTAAGTCTAATTCAGGACGTTGAGAGGATCTTGGATTATTC<br>CCTCTGCCAAGAAACCTGGAGCAAAATCAGAGCGGGTCTTCCAATCT<br>CTCCAGTGGATCTCAGCTATCTTGCTCCTAAAAACCCAGGAACCGGT<br>CCTGCTTTCACCATAATCAATGGTACCCTAAAATACTTTGAGACCAG<br>ATACATCAGAGTCGATATTGCTGCTCCAATCCTCTCAAGAATGGTCG<br>GAATGATCAGTGGAACTACCACAGAAAGGGAACTGTGGGATGACTGG<br>GCACCATATGAAGACGTGGAAATTGGACCCAATGGAGTTCTGAGGAC<br>CAGTTCAGGATATAAGTTTCCTTTATACATGATTGGACATGGTATGT<br>TGGACTCCGATCTTCATCTTAGCTCAAAGGCTCAGGTGTTCGAACAT<br>CCTCACATTCAAGACGCTGCTTCGCAACTTCCTGATGATGAGAGTTT<br>ATTTTTTGGTGATACTGGGCTATCCAAAAATCCAATCGAGCTTGTAG<br>AAGGTTGGTTCAGTAGTTGGAAAAGCTCTATTGCCTCTTTTTTCTTT<br>ATCATAGGGTTAATCATTGGACTATTCTTGGTTCTCCGAGTTGGTAT<br>CCATCTTTGCATTAAATTAAAGCACACCAAGAAAAGACAGATTTATA<br>CAGACATAGAGATGAACCGACTTGGAAAGTAA | |
| 5 | Guide scaf-<br>fold 174<br>without<br>spacer, with<br>one MS2<br>hairpin | ACTGGCGCTTTTATCTGATTACTTTGAGAGCCATCACCAGCGACTAT<br>GTCGTAGTGGGTAAAGCTCACATGAGGATCACCCATGTGAGCATCAA<br>AG | 35169 |
| 5 | Guide scaf-<br>fold 235<br>without<br>spacer, with<br>one MS2<br>hairpin | ACTGGCGCTTCTATCTGATTACTCTGAGCGCCATCACCAGCGACTAT<br>GTCGTAGTGGGTAAAGCCGCACATGAGGATCACCCATGTGAGGCATC<br>AGAG | 35170 |

* indicates cleavage sequence between adjacent components
** 5' to 3' orientation
f indicates a -1 frame-shift in the encoded construct (Gag-TFR-PR polyprotein)

Cell Culture and Transfection

HEK293T Lenti-X cell culture will be performed as described in Example 7, above, using the 5 plasmids of Table 104 (selecting either CasX 491 or 676 and guide 174 or 235.

Collection and Concentration

XDPs will be collected and concentrated as described in Example 12, above.

The results of this process are expected to generate version 206 XDPs with either CasX 491 or CasX 676, and guide scaffold 174 or guide scaffold 235.

Example 39: Demonstration of Dual-Editing at Two Different Genomic Loci Using Two Types of CasX RNPs Packaged and Delivered Via a Single XDP Particle In Vitro Experiments were performed to demonstrate the ability to encode, package and deliver two types of CasX RNPs within a single XDP particle for targeted editing at two different genomic loci. Here, XDP particles were generated to contain a CasX protein with gRNAs targeting the PTBP1 and the tdTomato STOP cassette and used to transduce tdTomato neuroprogenitor cells (NPCs) to demonstrate editing at the two genomic loci in vitro.

Materials and Methods:

XDP Construct Cloning:

Two XDP configurations were used to generate XDPs in these experiments. Specifically, V168 XDPs were produced with guide scaffold 226, while V206 XDPs were produced with guide scaffold 251. XDPs were engineered to package two types of RNPs within a single XDP: CasX variant 491 complexed with a PTBP1-targeting gRNA and CasX variant 491 complexed with a tdTomato-targeting gRNA. All XDP particles were pseudotyped with the VSV-G glycoprotein.

XDP structural plasmid cloning was performed as described in Example 7. XDP production using HEK293T Lenti-X cells was performed as described in Example 7. Briefly, adherent Lenti-X cells were seeded in 15 cm plates at 2E7 cells per plate in 20 mL of media. 24 hours later, cells were transfected with the following plasmids using PEI Max (Polypus): XDP structural plasmids encoding the HIV-1 Gag-pol structural components (as well as CasX 491 for V168), a plasmid encoding for CasX 491 (relevant for V206), a plasmid encoding a single gRNA with either scaffold 226 (for V168 XDPs) or scaffold 251 (for V206 XDPs) and PTBP1-targeting spacer 28.10 (CAGCGGG-GAUCCGACGAGCU; SEQ ID NO: 35171), a plasmid encoding a single gRNA with either scaffold 226 or 251 and tdTomato-targeting spacer 12.7 (CUGCAUUCUAGUU-GUGGUUU; SEQ ID NO: 1855), and a plasmid encoding the VSV-G glycoprotein. 72 hours post-transfection, XDP-containing media was collected and filtered through a 0.45 μm PES filter. The supernatant was concentrated and purified via centrifugation. XDPs were resuspended in freezing buffer. As experimental controls, XDPs containing dual-CasX RNPs using spacer 28.10 with a non-targeting (NT) spacer or dual-CasX RNPs using spacer 12.7 with an NT spacer were also produced and assessed for editing.

XDP transduction of tdTomato NPCs was performed as described in Example 7. Editing at the tdTomato locus was assessed by analyzing tdTomato fluorescence detected by flow cytometry, while editing at the PTBP1 locus was assessed as indel rate detected by NGS using methods as described in Example 7.

Results:

V168 XDPs were produced to achieve packaging of two types of CasX RNPs within a single XDP. Specifically, V168 XDPs contained either 1) RNPs of CasX 491 complexed with a tdTomato-targeting gRNA and CasX 491 complexed with a PTBP1-targeting gRNA (V168 12.7-28.10), or 2) RNPs of CasX 491 complexed with a tdTomato-targeting gRNA and CasX 491 complexed with a non-targeting gRNA (V168 12.7-NT). Produced V168 XDPs were subsequently assessed for their editing efficiency at the tdTomato locus or PTBP1 locus in mNPCs, and the results are illustrated in FIG. 139. The data demonstrate that V168 XDPs containing two types of CasX RNPs were able to achieve dose-dependent editing at both the tdTomato and PTBP1 loci when delivered into mNPCs. The data further suggest that similar levels of editing were achieved at both loci at the indicated volumes of XDP application.

Similarly, V206 XDPs were produced to achieve dual-CasX RNP packaging: 1) RNPs of CasX 491 complexed with a tdTomato-targeting gRNA and CasX 491 complexed with a PTBP1-targeting gRNA (V206 12.7-28.10); 2) RNPs of CasX 491 complexed with a tdTomato-targeting gRNA and CasX 491 complexed with a non-targeting gRNA (V206 12.7-NT); or 3) RNPs of CasX 491 complexed with a PTBP1-targeting gRNA and CasX 491 complexed with a non-targeting gRNA (V206 28.10-NT). Produced V206 XDPs were subsequently assessed for their editing efficiency at the tdTomato locus or PTBP1 locus in mNPCs, and the results are illustrated in FIG. 140. The data demonstrate that V206 XDPs packaging CasX RNPs for dual-targeting were able to induce similar levels of dose-dependent editing at both the tdTomato and PTBP1 loci when delivered into mNPCs. In addition, the data demonstrate that editing efficiency achieved by V206 XDPs containing CasX RNPs with either spacer 28.10 or 12.7 and a non-targeting (NT) spacer did not affect editing levels at either of the two targeted loci.

The results from these experiments show that XDPs with different configurations can be engineered to package two types of CasX RNPs (i.e., CasX is complexed with two different gRNAs) within a single XDP particle to achieve editing at two different genomic loci. Furthermore, while the experiments here utilized two separate plasmids to express the two different gRNAs for targeting, future experiments will use a single plasmid for dual-gRNA expression. These findings also justify additional studies to investigate in vivo editing after delivering XDPs containing CasX RNPs for dual-targeting of different genes. Demonstrating the potential to use XDPs to induce editing at multiple genomic loci offers a therapeutic opportunity to address polygenic diseases.

SEQUENCE LISTING (35173 sequences)

SEQ ID NO: 1 - protein, 986 aa, unidentified
  REGION 1..986: note = Deltaproteobacteria sp.
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 2 - protein, 978 aa, unidentified
  REGION 1..978: note = Planctomycetes sp.
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3 - protein, 855 aa, unidentified
  REGION 1..855: note = Candidatus Sungbacteria sp.
MDNANKPSTKSLVNTTRISDHFGVTPGQVTRVFSFGIIPTKRQYAIIERWFAAVEAARERLYGMLYAHFQENPPAYLKEKFSYETFFKGRPVLNGLRDIDPTIMTSAVFTALRHKAEGAMAAFHTNHRRLFEEARKKMREYAECLKANEALLRGAADIDWDKIVNALRTRLNTCLAPEYDAVIADFGALCAFRALIAETNALKGAYNHALNQMLPALVKVDEPEEAEESPRLRFFNGRINDLPKFPVAERETPPDTETIIRQLEDMARVIPDTAEILGYIHRIRHKAARRKPGSAVPLPQRVALYCAIRMERNPEEDPSTVAGHFLGEIDRVCEKRRQGLVRTPFDSQIRARYMDIISFRATLAHPDRWTEIQFLRSNAASRRVRAETISAPFEGFSWTSNRTNPAPQYGMALAKDANAPADAPELCICLSPSSAAFSVREKGGDLIYMRPTGGRRGKDNPGKEITWVPGSFDEYPASGVALKLRLYFGRSQARRMLTNKTWGLLSDNPRVFAANAELVGKKRNPQDRWKLFFHMVISGPPPVEYLDFSSDVRSRARTVIGINRGEVNPLAYAVVSVEDGQVLEEGLLGKKEYIDQLIETRRRISEYQSREQTPPRDLRQRVRHLQDTVLGSARAKIHSLIAFWKGILAIERLDDQFHGREQKIIPKKTYLANKTGFMNALSFSGAVRVDKKGNPWGGMIEIYPGGISRTCTQCGTVWLARRPKNPGHRDAMVVIPDIVDDAAATGFDNVDCDAGTVDYGELFTLSREWVRLTPRYSRVMRGTLGDLERAIRQGDDRKSRQMLELALEPQPQWGQFFCHRCGFNGQSDVLAATNLARRAISLIRRLPDTDTPPTP

SEQ ID NO: 4 - RNA, 108 nt, synthetic construct
  misc_feature 1..108: note = gRNA sequence
  source 1..108: mol_type = other RNA
acatctggcgcgtttattccattactttggagccagtcccagcgactatgtcgtatggacgaagcgcttatttatcggagagaaaccgataagtaaaacgcatcaaag

SEQ ID NO: 5 - RNA, 108 nt, synthetic construct
  misc_feature 1..108: note = gRNA sequence
  source 1..108: mol_type = other RNA
tactggcgcttttatctcattactttgagagccatcaccagcgactatgtcgtatgggtaaagcgcttatttatcggagagaaatccgataaataagaagcatcaaag

SEQ ID NO: 6 - RNA, 81 nt, synthetic construct
  misc_feature 1..81: note = gRNA sequence
  source 1..81: mol_type = other RNA
acatctggcgcgtttattccattactttggagccagtcccagcgactatgtcgtatggacgaagcgcttatttatcggaga

SEQ ID NO: 7 - RNA, 78 nt, synthetic construct
  misc_feature 1..78: note = gRNA sequence
  source 1..78: mol_type = other RNA
acatctggcgcgtttattccattactttggagccagtcccagcgactatgtcgtatggacgaagcgcttatttatcgg

SEQ ID NO: 8 - RNA, 80 nt, synthetic construct
  misc_feature 1..80: note = gRNA sequence
  source 1..80: mol_type = other RNA
tactggcgcttttatctcattactttgagagccatcaccagcgactatgtcgtatgggtaaagcgcttatttatcggaga

SEQ ID NO: 9 - RNA, 77 nt, synthetic construct
  misc_feature 1..77: note = gRNA sequence
  source 1..77: mol_type = other RNA
tactggcgcttttatctcattactttgagagccatcaccagcgactatgtcgtatgggtaaagcgcttatttatcgg

SEQ ID NO: 10 - RNA, 25 nt, synthetic construct
  misc_feature 1..25: note = gRNA sequence
  source 1..25: mol_type = other RNA
gtttacacactccctctcatagggt

SEQ ID NO: 11 - RNA, 25 nt, synthetic construct
  misc_feature 1..25: note = gRNA sequence
  source 1..25: mol_type = other RNA
gtttacacactccctctcatgaggt

SEQ ID NO: 12 - RNA, 25 nt, synthetic construct
  misc_feature 1..25: note = gRNA sequence
  source 1..25: mol_type = other RNA
ttttacataccccctctcatgggat

SEQ ID NO: 13 - RNA, 25 nt, synthetic construct
  misc_feature 1..25: note = gRNA sequence
  source 1..25: mol_type = other RNA
gtttacacactccctctcatggggg

SEQ ID NO: 14 - RNA, 20 nt, synthetic construct
  misc_feature 1..20: note = gRNA sequence
  source 1..20: mol_type = other RNA
ccagcgactatgtcgtatgg

SEQ ID NO: 15 - RNA, 39 nt, synthetic construct
  misc_feature 1..39: note = gRNA sequence
  source 1..39: mol_type = other RNA
gcgcttatttatcggagagaaatccgataaataagaagc

SEQ ID NO: 16 - RNA, 74 nt, synthetic construct
  misc_feature 1..74: note = gRNA sequence
  source 1..74: mol_type = other RNA
ggcgcttttatctcattactttgagagccatcaccagcgactatgtcgtatgggtaaagcgcttatttatcgga

SEQ ID NO: 17 - skipped

SEQ ID NO: 18 - protein, 7 aa, synthetic construct
  REGION 1..7: note = TEV protease cleavage site
ENLYFQG

SEQ ID NO: 19 - protein, 7 aa, synthetic construct
  REGION 1..7: note = TEV protease cleavage site
ENLYFQS

SEQ ID NO: 20 - protein, 8 aa, synthetic construct
  REGION 1..8: note = HIV-1 cleavage site
SQNYPIVQ

SEQ ID NO: 21 - protein, 84 aa, synthetic construct
  REGION 1..84: note = chloroplast transit peptide
MASMISSSAVTTVSRASRGQSAAMAPFGGLKSMTGFPVRKVNTDITSITSNGGRVKCMQVWPPIGKKKFETLSYLPPLTRDSRA

SEQ ID NO: 22 - protein, 57 aa, synthetic construct
  REGION 1..57: note = chloroplast transit peptide
MASMISSSAVTTVSRASRGQSAAMAPFGGLKSMTGFPVRKVNTDITSITSNGGRVKS

SEQ ID NO: 23 - protein, 85 aa, synthetic construct
  REGION 1..85: note = chloroplast transit peptide
MASSMLSSATMVASPAQATMVAPFNGLKSSAAFPATRKANNDITSITSNGGRVNCMQVWPPIEKKKFETLSYLPDLTDSGGRVNC

SEQ ID NO: 24 - protein, 76 aa, synthetic construct
  REGION 1..76: note = chloroplast transit peptide
MAQVSRICNGVQNPSLISNLSKSSQRKSPLSVSLKTQQHPRAYPISSSWGLKKSGMTLIGSELRPLKVMSSVSTAC

SEQ ID NO: 25 - protein, 76 aa, synthetic construct
  REGION 1..76: note = chloroplast transit peptide
MAQVSRICNGVWNPSLISNLSKSSQRKSPLSVSLKTQQHPRAYPISSSWGLKKSGMTLIGSELRPLKVMSSVSTAC

SEQ ID NO: 26 - protein, 72 aa, synthetic construct
  REGION 1..72: note = chloroplast transit peptide
MAQINNMAQGIQTLNPNSNFHKPQVPKSSSFLVFGSKKLKNSANSMLVLKKDSIFMQLFCSFRISASVATAC

SEQ ID NO: 27 - protein, 69 aa, synthetic construct
  REGION 1..69: note = chloroplast transit peptide
MAALVTSQLATSGTVLSVTDRFRRPGFQGLRPRNPADAALGMRTVGASAAPKQSRKPHRFDRRCLSMVV

SEQ ID NO: 28 - protein, 77 aa, synthetic construct
  REGION 1..77: note = chloroplast transit peptide
MAALTTSQLATSATGFGIADRSAPSSLLRHGFQGLKPRSPAGGDATSLSVTTSARATPKQQRSVQRGSRRFPSVVVC

SEQ ID NO: 29 - protein, 57 aa, synthetic construct
  REGION 1..57: note = chloroplast transit peptide
MASSVLSSAAVATRSNVAQANMVAPFTGLKSAASFPVSRKQNLDITSIASNGGRVQC

SEQ ID NO: 30 - protein, 65 aa, synthetic construct
  REGION 1..65: note = chloroplast transit peptide
MESLAATSVFAPSRVAVPAARALVRAGTVVPTRRTSSTSGTSGVKCSAAVTPQASPVISRSAAAA

SEQ ID NO: 31 - protein, 72 aa, synthetic construct
  REGION 1..72: note = chloroplast transit peptide
MGAAATSMQSLKFSNRLVPPSRRLSPVPNNVTCNNLPKSAAPVRTVKCCASSWNSTINGAAATTNGASAASS

SEQ ID NO: 32 - protein, 20 aa, synthetic construct
  REGION 1..20: note = endosomal escape peptide
  VARIANT 4: note = K, H or R
  VARIANT 8: note = K, H or R
  VARIANT 11: note = K, H or R
  VARIANT 15: note = K, H or R
  VARIANT 19: note = K, H or R
GLFXALLXLLXSLWXLLLXA

SEQ ID NO: 33 - protein, 20 aa, synthetic construct
  REGION 1..20: note = endosomal escape peptide
GLFHALLHLLHSLWHLLLHA

SEQ ID NO: 34 - protein, 9 aa, synthetic construct
  REGION 1..9: note = endosomal escape peptide
HHHHHHHHH

SEQ ID NO: 35 - protein, 7 aa, synthetic construct
  REGION 1..7: note = nuclear localization signal
PKKKRKV

SEQ ID NO: 36 - protein, 16 aa, synthetic construct
  REGION 1..16: note = nuclear localization signal
KRPAATKKAGQAKKKK

SEQ ID NO: 37 - protein, 9 aa, synthetic construct
  REGION 1..9: note = nuclear localization signal
PAAKRVKLD

SEQ ID NO: 38 - protein, 11 aa, synthetic construct
  REGION 1..11: note = nuclear localization signal
RQRRNELKRSP

SEQ ID NO: 39 - protein, 38 aa, synthetic construct
  REGION 1..38: note = nuclear localization signal
NQSSNFGPMKGGNFGGRSSGPYGGGGQYFAKPRNQGGY

SEQ ID NO: 40 - protein, 42 aa, synthetic construct
  REGION 1..42: note = nuclear localization signal
RMRIZFKNKGKDTAELRRRRVEVSVELRKAKKDEQILKRRNV

SEQ ID NO: 41 - protein, 8 aa, synthetic construct
  REGION 1..8: note = nuclear localization signal
VSRKRPRP

SEQ ID NO: 42 - protein, 8 aa, synthetic construct
  REGION 1..8: note = nuclear localization signal
PPKKARED

SEQ ID NO: 43 - protein, 8 aa, synthetic construct
  REGION 1..8: note = nuclear localization signal
PQPKKKPL

SEQ ID NO: 44 - protein, 12 aa, synthetic construct
  REGION 1..12: note = nuclear localization signal
SALIKKKKKMAP

SEQ ID NO: 45 - protein, 5 aa, synthetic construct
  REGION 1..5: note = nuclear localization signal
DRLRR

SEQ ID NO: 46 - protein, 7 aa, synthetic construct
  REGION 1..7: note = nuclear localization signal
PKQKKRK

SEQ ID NO: 47 - protein, 10 aa, synthetic construct
  REGION 1..10: note = nuclear localization signal
RKLKKKIKKL

SEQ ID NO: 48 - protein, 10 aa, synthetic construct
  REGION 1..10: note = nuclear localization signal
REKKKFLKRR

SEQ ID NO: 49 - protein, 20 aa, synthetic construct
  REGION 1..20: note = nuclear localization signal
KRKGDEVDGVDEVAKKKSKK

SEQ ID NO: 50 - protein, 17 aa, synthetic construct
  REGION 1..17: note = nuclear localization signal
RKCLQAGMNLEARKTKK

SEQ ID NO: 51 - protein, 8 aa, synthetic construct
  REGION 1..8: note = nuclear localization signal
PRPRKIPR

SEQ ID NO: 52 - protein, 9 aa, synthetic construct
  REGION 1..9: note = nuclear localization signal
PPRKKRTVV

SEQ ID NO: 53 - protein, 12 aa, synthetic construct
  REGION 1..12: note = nuclear localization signal
NLSKKKKRKREK

SEQ ID NO: 54 - protein, 10 aa, synthetic construct
  REGION 1..10: note = nuclear localization signal
RRPSRPFRKP

SEQ ID NO: 55 - protein, 8 aa, synthetic construct
  REGION 1..8: note = nuclear localization signal
KRPRSPSS

SEQ ID NO: 56 - protein, 19 aa, synthetic construct
  REGION 1..19: note = nuclear localization signal
KRGINDRNFWRGENERKTR

SEQ ID NO: 57 - protein, 11 aa, synthetic construct
  REGION 1..11: note = nuclear localization signal
PRPPKMARYDN

SEQ ID NO: 58 - protein, 9 aa, synthetic construct
  REGION 1..9: note = nuclear localization signal
KLKIKRPVK

SEQ ID NO: 59 - protein, 19 aa, synthetic construct
  REGION 1..19: note = nuclear localization signal
PKKKRKVPPPPAAKRVKLD

SEQ ID NO: 60 - protein, 17 aa, synthetic construct
  REGION 1..17: note = nuclear localization signal
PKTRRRPRRSQRKRPPT

SEQ ID NO: 61 - protein, 24 aa, synthetic construct
  REGION 1..24: note = nuclear localization signal
SRRRKANPTKLSENAKKLAKEVEN

SEQ ID NO: 62 - protein, 16 aa, synthetic construct
  REGION 1..16: note = nuclear localization signal
KTRRRPRRSQRKRPPT

SEQ ID NO: 63 - protein, 13 aa, synthetic construct
  REGION 1..13: note = nuclear localization signal
RRKKRRPRRKKRR

SEQ ID NO: 64 - protein, 14 aa, synthetic construct
  REGION 1..14: note = nuclear localization signal
PKKKSRKPKKKSRK

SEQ ID NO: 65 - protein, 17 aa, synthetic construct
  REGION 1..17: note = nuclear localization signal
HKKKHPDASVNFSEFSK

SEQ ID NO: 66 - protein, 18 aa, synthetic construct
  REGION 1..18: note = nuclear localization signal
QRPGPYDRPQRPGPYDRP

SEQ ID NO: 67 - protein, 16 aa, synthetic construct
  REGION 1..16: note = nuclear localization signal
LSPSLSPLLSPSLSPL

SEQ ID NO: 68 - protein, 18 aa, synthetic construct
  REGION 1..18: note = nuclear localization signal
RGKGGKGLGKGGAKRHRK

SEQ ID NO: 69 - protein, 14 aa, synthetic construct
  REGION 1..14: note = nuclear localization signal
PKRGRGRPKRGRGR

SEQ ID NO: 70 - protein, 19 aa, synthetic construct
  REGION 1..19: note = nuclear localization signal
PKKKRKVPPPPAAKRVKLD

SEQ ID NO: 71 - protein, 17 aa, synthetic construct
  REGION 1..17: note = nuclear localization signal
PKKKRKVPPPPKKKRKV

SEQ ID NO: 72 - protein, 11 aa, synthetic construct
  REGION 1..11: note = nuclear localization signal
PAKRARRGYKC

SEQ ID NO: 73 - protein, 11 aa, synthetic construct
  REGION 1..11: note = nuclear localization signal
KLGPRKATGRW

SEQ ID NO: 74 - protein, 7 aa, synthetic construct
  REGION 1..7: note = nuclear localization signal
PRRKREE

SEQ ID NO: 75 - protein, 7 aa, synthetic construct
  REGION 1..7: note = nuclear localization signal
PYRGRKE

SEQ ID NO: 76 - protein, 8 aa, synthetic construct
  REGION 1..8: note = nuclear localization signal
PLRKRPRR

SEQ ID NO: 77 - protein, 18 aa, synthetic construct
  REGION 1..18: note = nuclear localization signal
PLRKRPRRGSPLRKRPRR

SEQ ID NO: 78 - protein, 29 aa, synthetic construct
  REGION 1..29: note = nuclear localization signal
PAAKRVKLDGGKRTADGSEFESPKKKRKV

SEQ ID NO: 79 - protein, 37 aa, synthetic construct
  REGION 1..37: note = nuclear localization signal
PAAKRVKLDGGKRTADGSEFESPKKKRKVGIHGVPAA

SEQ ID NO: 80 - protein, 46 aa, synthetic construct
  REGION 1..46: note = nuclear localization signal
PAAKRVKLDGGKRTADGSEFESPKKKRKVAEAAAKEAAAKEAAAKA

SEQ ID NO: 81 - protein, 31 aa, synthetic construct
  REGION 1..31: note = nuclear localization signal
PAAKRVKLDGGKRTADGSEFESPKKKRKVPG

SEQ ID NO: 82 - protein, 28 aa, synthetic construct
  REGION 1..28: note = nuclear localization signal
KRTADSQHSTPPKTKRKVEFEPKKKRKV

SEQ ID NO: 83 - protein, 38 aa, synthetic construct
  REGION 1..38: note = nuclear localization signal
PKKKRKVGGSKRTADSQHSTPPKTKRKVEFEPKKKRKV

SEQ ID NO: 84 - protein, 5 aa, synthetic construct
  REGION 1..5: note = linker peptide
  VARIANT 2..5: note = individual amino acid residues may be present or absent
GGGGG

SEQ ID NO: 85 - protein, 10 aa, synthetic construct
  REGION 1..10: note = linker peptide
  VARIANT 3..4: note = grouped amino acid residues may be present or absent
  VARIANT 5..6: note = grouped amino acid residues may be present or absent
  VARIANT 7..8: note = grouped amino acid residues may be present or absent
  VARIANT 9..10: note = grouped amino acid residues may be present or absent
GSGSGSGSGS

SEQ ID NO: 86 - protein, 25 aa, synthetic construct
  REGION 1..25: note = linker peptide
  VARIANT 6..10: note = grouped amino acid residues may be present or absent
  VARIANT 11..15: note = grouped amino acid residues may be present or absent
  VARIANT 16..20: note = grouped amino acid residues may be present or absent
  VARIANT 21..25: note = grouped amino acid residues may be present or absent
GSGGSGSGGSGSGGSGSGGSGSGGS

SEQ ID NO: 87 - protein, 30 aa, synthetic construct
  REGION 1..30: note = linker peptide
  VARIANT 7..12: note = grouped amino acid residues may be present or absent
  VARIANT 13..18: note = grouped amino acid residues may be present or absent
  VARIANT 19..24: note = grouped amino acid residues may be present or absent
  VARIANT 25..30: note = grouped amino acid residues may be present or absent
GGSGGSGGSGGSGGSGGSGGSGGSGGSGGS

SEQ ID NO: 88 - protein, 20 aa, synthetic construct
  REGION 1..20: note = linker peptide
  VARIANT 5..8: note = grouped amino acid residues may be present or absent
  VARIANT 9..12: note = grouped amino acid residues may be present or absent
  VARIANT 13..16: note = grouped amino acid residues may be present or absent
  VARIANT 17..20: note = grouped amino acid residues may be present or absent
GGGSGGGSGGGSGGGSGGGS

SEQ ID NO: 89 - protein, 4 aa, synthetic construct
  REGION 1..4: note = linker peptide
GGSG

SEQ ID NO: 90 - protein, 5 aa, synthetic construct
  REGION 1..5: note = linker peptide
GGSGG

SEQ ID NO: 91 - protein, 5 aa, synthetic construct
  REGION 1..5: note = linker peptide
GSGSG

SEQ ID NO: 92 - protein, 5 aa, synthetic construct
  REGION 1..5: note = linker peptide
GSGGG

SEQ ID NO: 93 - protein, 5 aa, synthetic construct
  REGION 1..5: note = linker peptide
GGGSG

SEQ ID NO: 94 - protein, 5 aa, synthetic construct
  REGION 1..5: note = linker peptide
GSSSG

SEQ ID NO: 95 - protein, 4 aa, synthetic construct
  REGION 1..4: note = linker peptide
GPGP

SEQ ID NO: 96 - protein, 6 aa, synthetic construct
  REGION 1..6: note = linker peptide
PPAPPA

SEQ ID NO: 97 - protein, 4 aa, synthetic construct
  REGION 1..4: note = linker peptide
PPPG

SEQ ID NO: 98 - protein, 7 aa, synthetic construct
  REGION 1..7: note = linker peptide
PPPGPPP

SEQ ID NO: 99 - protein, 23 aa, synthetic construct
  REGION 1..23: note = linker peptide
  VARIANT 8..11: note = grouped amino acid residues may be present or absent
  VARIANT 12..15: note = grouped amino acid residues may be present or absent
  VARIANT 16..19: note = grouped amino acid residues may be present or absent
  VARIANT 20..23: note = grouped amino acid residues may be present or absent
PPPGGGSGGGSGGGSGGGSGGGS

SEQ ID NO: 100 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 101 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLRSQEYKKYQTNKTTGNTDKRAFVETWQSFYRKKLKEVWKPAV

SEQ ID NO: 102 - protein, 985 aa, synthetic construct
  REGION 1..985: note = CasX Variant
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 103 - protein, 986 aa, synthetic construct
  REGION 1..986: note = CasX Variant
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

SEQ ID NO: 104 - protein, 921 aa, synthetic construct
  REGION 1..921: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 105 - protein, 920 aa, synthetic construct
  REGION 1..920: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 106 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 107 - protein, 986 aa, synthetic construct
  REGION 1..986: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 108 - protein, 925 aa, synthetic construct
  REGION 1..925: note = CasX Variant
MISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 109 - protein, 975 aa, synthetic construct
  REGION 1..975: note = CasX Variant
MEKRINKIRKKLSADNATKPVSRSGPMKTLLVRVMTDDLKKRLEKRRKKPEVMPQVISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 110 - protein, 982 aa, synthetic construct
  REGION 1..982: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 111 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 112 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFAAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPA

SEQ ID NO: 113 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 114 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDQLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 115 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFQAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 116 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLIAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTVRDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 117 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 118 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTTRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 119 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGSLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 120 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 121 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEKEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 122 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 123 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 124 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSESDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 125 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 126 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGDPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 127 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEFLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 128 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 129 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 130 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 131 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIIIEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFNAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 132 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAKTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 133 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRNEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 134 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIMENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 135 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 136 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 137 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 138 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 139 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 140 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQVRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 141 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 142 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 143 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 144 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 145 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 146 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 147 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 148 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 149 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 150 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 151 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 152 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 153 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 154 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 155 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 156 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 157 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 158 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 159 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 160 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 161 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 162 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 163 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 164 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 165 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 166 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 167 - protein, 977 aa, synthetic construct
  REGION 1..977: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 168 - protein, 976 aa, synthetic construct
  REGION 1..976: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 169 - protein, 977 aa, synthetic construct; identical to SEQ ID NO: 135
  REGION 1..977: note = CasX Variant

SEQ ID NO: 170 - protein, 977 aa, synthetic construct; identical to SEQ ID NO: 135
  REGION 1..977: note = CasX Variant

SEQ ID NO: 171 - protein, 977 aa, synthetic construct; identical to SEQ ID NO: 135
  REGION 1..977: note = CasX Variant

SEQ ID NO: 172 - protein, 977 aa, synthetic construct; identical to SEQ ID NO: 135
  REGION 1..977: note = CasX Variant

SEQ ID NO: 173 - protein, 977 aa, synthetic construct; identical to SEQ ID NO: 135
  REGION 1..977: note = CasX Variant

SEQ ID NO: 174 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTMSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 175 - protein, 977 aa, synthetic construct; identical to SEQ ID NO: 135
  REGION 1..977: note = CasX Variant

SEQ ID NO: 176 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 177 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAGPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 178 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPISKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 179 - protein, 977 aa, synthetic construct; identical to SEQ ID NO: 135
  REGION 1..977: note = CasX Variant

SEQ ID NO: 180 - protein, 977 aa, synthetic construct; identical to SEQ ID NO: 135
  REGION 1..977: note = CasX Variant

SEQ ID NO: 181 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 182 - protein, 976 aa, synthetic construct
  REGION 1..976: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 183 - protein, 976 aa, synthetic construct
  REGION 1..976: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 184 - protein, 976 aa, synthetic construct
  REGION 1..976: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 185 - protein, 976 aa, synthetic construct
  REGION 1..976: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 186 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 187 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 188 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 189 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 190 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 191 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLGVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 192 - protein, 986 aa, synthetic construct; identical to SEQ ID NO: 107
  REGION 1..986: note = CasX Variant

SEQ ID NO: 193 - protein, 978 aa, synthetic construct
  REGION 1..978: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 194 - protein, 972 aa, synthetic construct
  REGION 1..972: note = CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

SEQ ID NO: 195 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTIHTSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 196 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 197 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNHNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 198 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 199 - protein, 979 aa, synthetic construct
  REGION 1..979: note = CasX Variant
RQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 200 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHIQLRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 201 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTTQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 202 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKRSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 203 - protein, 977 aa, synthetic construct
  REGION 1..977: note = CasX Variant
QEIKRINKIRRRLVKDSNTKKAGKTYPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 204 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTIHSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 205 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAATQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 206 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 207 - protein, 978 aa, synthetic construct
  REGION 1..978: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 208 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 209 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASNPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 210 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGWGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 211 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGYGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 212 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 213 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 214 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASHPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 215 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 216 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASTPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 217 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 218 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASVPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 219 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSLACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 220 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSNACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 221 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSQACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 222 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSSACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 223 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSAACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 224 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 225 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSTACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 226 - protein, 978 aa, synthetic construct
  REGION 1..978: note = CasX Variant
QEIKRINKIRRRLVKDSNTKKAGKRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 227 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLHDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 228 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKEGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 229 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNINLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 230 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLFSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 231 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKWLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 232 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNDNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 233 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSTQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 234 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLDQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 235 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIPLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 236 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKKAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 237 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLKYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 238 - protein, 978 aa, synthetic construct
  REGION 1..978: note = CasX Variant
QEGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 239 - protein, 978 aa, synthetic construct
  REGION 1..978: note = CasX Variant
QEEKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 240 - protein, 979 aa, synthetic construct
  REGION 1..979: note = CasX Variant
QEIGKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 241 - protein, 978 aa, synthetic construct
  REGION 1..978: note = CasX Variant
QEIGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 242 - protein, 978 aa, synthetic construct
  REGION 1..978: note = CasX Variant
QEISRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 243 - protein, 979 aa, synthetic construct
  REGION 1..979: note = CasX Variant
QEIKGRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 244 - protein, 978 aa, synthetic construct
  REGION 1..978: note = CasX Variant
QEIKSINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 245 - protein, 978 aa, synthetic construct
  REGION 1..978: note = CasX Variant
QEIKRANKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 246 - protein, 979 aa, synthetic construct
  REGION 1..979: note = CasX Variant
QEIKRGINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 247 - protein, 978 aa, synthetic construct
  REGION 1..978: note = CasX Variant
QEIKRISKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 248 - protein, 978 aa, synthetic construct
  REGION 1..978: note = CasX Variant
QEIKRINGIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 249 - protein, 979 aa, synthetic construct
  REGION 1..979: note = CasX Variant
QEIKRINKIRRRLVKFDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 250 - protein, 979 aa, synthetic construct
  REGION 1..979: note = CasX Variant
QEIKRINKIRRRLVKDSFNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 251 - protein, 978 aa, synthetic construct
  REGION 1..978: note = CasX Variant
QEIKRINKIRRRLVKDSNTKKAGKTGPMKTLLVPVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 252 - protein, 978 aa, synthetic construct
  REGION 1..978: note = CasX Variant
QEIKRINKIRRRLVKDSNTKKAGKTGPMKTLLVRVMTPDLRERLENLRKKPPNIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 253 - protein, 979 aa, synthetic construct
  REGION 1..979: note = CasX Variant
QEIKRINKIRRRLVKDSNTKKAGKTGPMKTLLVRVMTPDLRERLENLRKKPENIPPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 254 - protein, 978 aa, synthetic construct
  REGION 1..978: note = CasX Variant
QEIKRINKIRRRLVKDSNTKKAGKTGPMKTLLVRVMTPDLRERLENLRKKPENIPPPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 255 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSSANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 256 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSQANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 257 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAITHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 258 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYGEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 259 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYDEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 260 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYAEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 261 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYREEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 262 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 263 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLYQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 264 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLSQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 265 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPPKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 266 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 267 - protein, 978 aa, synthetic construct; identical to SEQ ID NO: 215
  REGION 1..978: note = CasX Variant

SEQ ID NO: 268 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTGEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 269 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTSEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 270 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGLDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 271 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRTWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 272 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRWWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 273 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKNFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 274 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPQFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 275 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPALVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 276 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 277 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVPRQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 278 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVRQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 279 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVLRQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 280 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVRRQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 281 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 282 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANHEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 283 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANAEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 284 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 285 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWPDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 286 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARTQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 287 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLMDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 288 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLNHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 289 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLWHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 290 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLYKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 291 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHPEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 292 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHEGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 293 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGERDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 294 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEWDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 295 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEYDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 296 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDYWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 297 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDRGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 298 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGDVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 299 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGPVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 300 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKLYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 301 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYGEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 302 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHQKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 303 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEEDRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 304 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAATTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 305 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKTSFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 306 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKKSFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 307 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVEEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 308 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVISEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 309 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIERGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 310 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGKKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 311 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGSKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 312 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADDKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 313 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDQEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 314 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEKCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 315 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRDELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 316 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCVELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 317 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCDLKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 318 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCERKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 319 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKHQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 320 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQPWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 321 - protein, 978 aa, synthetic construct; identical to SEQ ID NO: 233
  REGION 1..978: note = CasX Variant

SEQ ID NO: 322 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRFGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 323 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRVGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 324 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 325 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKTPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 326 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKNPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 327 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPRMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 328 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMSNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 329 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIWESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 330 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIRESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 331 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQASKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 332 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVHNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 333 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFSAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 334 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFAAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 335 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWDKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 336 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGNEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 337 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARVWLFLRSQEYKKYQTNKTTGNTDKRAFVETWQSFYRKKLKEVWKPAV

SEQ ID NO: 338 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTINTDKRAFVETWQSFYRKKLKEVWKPAV

SEQ ID NO: 339 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 340 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 341 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 342 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 343 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 344 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFEDREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 345 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKHPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 346 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLIINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 347 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 348 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 349 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 350 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 351 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 352 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 353 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 354 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 355 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 356 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 357 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASHPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 358 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 359 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASHPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 360 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 361 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASYPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 362 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASGPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 363 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASYPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 364 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASHPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 365 - protein, 979 aa, synthetic construct; identical to SEQ ID NO: 213
  REGION 1..979: note = CasX Variant

SEQ ID NO: 366 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASHPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 367 - protein, 978 aa, synthetic construct; identical to SEQ ID NO: 262
  REGION 1..978: note = CasX Variant

SEQ ID NO: 368 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 369 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASHPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 370 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 371 - protein, 979 aa, synthetic construct
  REGION 1..979: note = CasX Variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASHPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 372 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASHPVGKALSGACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 373 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNARRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 374 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQVDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 375 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEGEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 376 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLEHLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 377 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQICAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 378 - protein, 976 aa, synthetic construct
  REGION 1..976: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 379 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFGGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 380 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKLVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 381 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGQFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 382 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVSWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 383 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLREKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 384 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTTYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 385 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEANRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 386 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEELRRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 387 - protein, 976 aa, synthetic construct
  REGION 1..976: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDERCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 388 - protein, 976 aa, synthetic construct
  REGION 1..976: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 389 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRQKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 390 - protein, 978 aa, synthetic construct
  REGION 1..978: note = CasX Variant
QEIKRLNKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 391 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLDAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 392 - protein, 976 aa, synthetic construct
  REGION 1..976: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 393 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYVGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 394 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINGEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 395 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRFASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 396 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWYTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 397 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVPCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 398 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQTIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 399 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPCQEKFVCLNCGFETHADEQAALNIARSWLFLRSQEYKKYQTNKTTGNTDKRAFVETWQSFYRKKLKEVWKPAV

SEQ ID NO: 400 - protein, 979 aa, synthetic construct
  REGION 1..979: note = CasX Variant
QEIKRINKIRRRLVKDSNTKKAGKTGPMKTLLVRVMTPDLRERLENLPRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 401 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEGLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 402 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 403 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTISKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 404 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTKSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 405 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKQLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 406 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYYSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 407 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAKYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 408 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLASKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 409 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 410 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 411 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTWITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 412 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKHTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 413 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKPCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 414 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 415 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 416 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLFAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 417 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKNTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 418 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGPTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 419 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTWLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 420 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTMSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 421 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 422 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSVNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 423 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTPKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 424 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWPLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 425 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCMSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 426 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLARYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 427 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYFSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 428 - protein, 977 aa, synthetic construct
  REGION 1..977: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 429 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSQTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 430 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYNGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 431 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLHSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 432 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKVYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 433 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLQAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 434 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGPLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 435 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKRTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 436 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCWGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 437 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLANYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 438 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNSGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 439 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLSQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 440 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYRLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 441 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKRAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 442 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKDAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 443 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 444 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYMSGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 445 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAIYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 446 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDVRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 447 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDREKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 448 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEMFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 449 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKQNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 450 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVIMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 451 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVNDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 452 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSGKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 453 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 454 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 455 - protein, 978 aa, synthetic construct
  REGION 1..978: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCEFETHADEQAALNIARSWLFLRSQEYKKYQTNKTTGNTDKRAFVETWQSFYRKKLKEVWKPAV

SEQ ID NO: 456 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTSTGNTDKRAFVETWQSFYRKKLKEVWKPAV

SEQ ID NO: 457 - protein, 979 aa, synthetic construct
  REGION 1..979: note = CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGKNTDKRAFVETWQSFYRKKLKEVWKPAV

SEQ ID NO: 458 - protein, 23 aa, synthetic construct
  REGION 1..23: note = linker peptide
  VARIANT 1..4: note = grouped amino acid residues may be present or absent
  VARIANT 5..8: note = grouped amino acid residues may be present or absent
  VARIANT 9..12: note = grouped amino acid residues may be present or absent
  VARIANT 13..16: note = grouped amino acid residues may be present or absent
GGGSGGGSGGGSGGGSGGGSPPP

SEQ ID NO: 459 - protein, 17 aa, synthetic construct
  REGION 1..17: note = linker peptide
AEAAAKEAAAKEAAAKA

SEQ ID NO: 460 - protein, 12 aa, synthetic construct
  REGION 1..12: note = linker peptide
TPPKTKRKVEFE

SEQ ID NO: 461 - protein, 46 aa, synthetic construct
  REGION 1..46: note = nuclear localization signal
PKKKRKVGGSPKKKRKVSRQEIKRINKIRRRLVKDSNTKKAGKTGP

SEQ ID NO: 462 - protein, 66 aa, synthetic construct
  REGION 1..66: note = nuclear localization signal
PKKKRKVGGSPKKKRKVGGSPKKKRKVGGSPKKKRKVSRQEIKRINKIRRRLVKDSNTKKAGKTGP

SEQ ID NO: 463 - protein, 86 aa, synthetic construct
  REGION 1..86: note = nuclear localization signal
PKKKRKVGGSPKKKRKVGGSPKKKRKVGGSPKKKRKVGGSPKKKRKVGGSPKKKRKVSRQEIKRINKIRRRLVKDSNTKKAGKTGP

SEQ ID NO: 464 - protein, 50 aa, synthetic construct
  REGION 1..50: note = nuclear localization signal
PAAKRVKLDGGSPAAKRVKLDSRQEIKRINKIRRRLVKDSNTKKAGKTGP

SEQ ID NO: 465 - protein, 74 aa, synthetic construct
  REGION 1..74: note = nuclear localization signal
PAAKRVKLDGGSPAAKRVKLDGGSPAAKRVKLDGGSPAAKRVKLDSRQEIKRINKIRRRLVKDSNTKKAGKTGP

SEQ ID NO: 466 - protein, 98 aa, synthetic construct
  REGION 1..98: note = nuclear localization signal
PAAKRVKLDGGSPAAKRVKLDGGSPAAKRVKLDGGSPAAKRVKLDGGSPAAKRVKLDGGSPAAKRVKLDSRQEIKRINKIRRRLVKDSNTKKAGKTGP

SEQ ID NO: 467 - protein, 49 aa, synthetic construct
  REGION 1..49: note = nuclear localization signal
KRPAATKKAGQAKKKKSRDISRQEIKRINKIRRRLVKDSNTKKAGKTGP

SEQ ID NO: 468 - protein, 45 aa, synthetic construct
  REGION 1..45: note = nuclear localization signal
KRPAATKKAGQAKKKKSRQEIKRINKIRRRLVKDSNTKKAGKTGP

SEQ ID NO: 469 - protein, 68 aa, synthetic construct
  REGION 1..68: note = nuclear localization signal
KRPAATKKAGQAKKKKGGSKRPAATKKAGQAKKKKSRDISRQEIKRINKIRRRLVKDSNTKKAGKTGP

SEQ ID NO: 470 - protein, 106 aa, synthetic construct
  REGION 1..106: note = nuclear localization signal
KRPAATKKAGQAKKKKGGSKRPAATKKAGQAKKKKGGSKRPAATKKAGQAKKKKGGSKRPAATKKAGQAKKKKSRDISRQEIKRINKIRRRLVKDSNTKKAGKTGP

SEQ ID NO: 471 - protein, 144 aa, synthetic construct
  REGION 1..144: note = nuclear localization signal
KRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKKSRDISRQEIKRINKIRRRLVKDSNTKKAGKTGP

SEQ ID NO: 472 - protein, 70 aa, synthetic construct
  REGION 1..70: note = nuclear localization signal
PKKKRKVGGSPKKKRKVGGSPKKKRKVGGSPKKKRKVSRDISRQEIKRINKIRRRLVKDSNTKKAGKTGP

SEQ ID NO: 473 - protein, 70 aa, synthetic construct; identical to SEQ ID NO: 472
  REGION 1..70: note = nuclear localization signal

SEQ ID NO: 474 - protein, 78 aa, synthetic construct
  REGION 1..78: note = nuclear localization signal
PAAKRVKLDGGSPAAKRVKLDGGSPAAKRVKLDGGSPAAKRVKLDSRDISRQEIKRINKIRRRLVKDSNTKKAGKTGP

SEQ ID NO: 475 - protein, 102 aa, synthetic construct
  REGION 1..102: note = nuclear localization signal
PAAKRVKLDGGSPAAKRVKLDGGSPAAKRVKLDGGSPAAKRVKLDGGSPAAKRVKLDGGSPAAKRVKLDSRDISRQEIKRINKIRRRLVKDSNTKKAGKTGP

SEQ ID NO: 476 - protein, 49 aa, synthetic construct; identical to SEQ ID NO: 467
  REGION 1..49: note = nuclear localization signal

SEQ ID NO: 477 - protein, 68 aa, synthetic construct; identical to SEQ ID NO: 469
  REGION 1..68: note = nuclear localization signal

SEQ ID NO: 478 - protein, 65 aa, synthetic construct
  REGION 1..65: note = nuclear localization signal
PAAKRVKLDGGKRTADGSEFESPKKKRKVGGSSRDISRQEIKRINKIRRRLVKDSNTKKAGKTGP

SEQ ID NO: 479 - protein, 67 aa, synthetic construct
  REGION 1..67: note = nuclear localization signal
PAAKRVKLDGGKRTADGSEFESPKKKRKVPPPPGSRDISRQEIKRINKIRRRLVKDSNTKKAGKTGP

SEQ ID NO: 480 - protein, 72 aa, synthetic construct
  REGION 1..72: note = nuclear localization signal
PAAKRVKLDGGKRTADGSEFESPKKKRKVGIHGVPAAPGSRDISRQEIKRINKIRRRLVKDSNTKKAGKTGP

SEQ ID NO: 481 - protein, 72 aa, synthetic construct
  REGION 1..72: note = nuclear localization signal
PAAKRVKLDGGKRTADGSEFESPKKKRKVGGGSGGGSPGSRDISRQEIKRINKIRRRLVKDSNTKKAGKTGP

SEQ ID NO: 482 - protein, 73 aa, synthetic construct
  REGION 1..73: note = nuclear localization signal
PAAKRVKLDGGKRTADGSEFESPKKKRKVPGGGSGGGSPGSRDISRQEIKRINKIRRRLVKDSNTKKAGKTGP

SEQ ID NO: 483 - protein, 81 aa, synthetic construct
  REGION 1..81: note = nuclear localization signal
PAAKRVKLDGGKRTADGSEFESPKKKRKVAEAAAKEAAAKEAAAKAPGSRDISRQEIKRINKIRRRLVKDSNTKKAGKTGP

SEQ ID NO: 484 - protein, 64 aa, synthetic construct
  REGION 1..64: note = nuclear localization signal
PAAKRVKLDGGKRTADGSEFESPKKKRKVPGSRDISRQEIKRINKIRRRLVKDSNTKKAGKTGP

SEQ ID NO: 485 - protein, 55 aa, synthetic construct
  REGION 1..55: note = nuclear localization signal
PAAKRVKLDGGSPKKKRKVGGSSRDISRQEIKRINKIRRRLVKDSNTKKAGKTGP

SEQ ID NO: 486 - protein, 54 aa, synthetic construct
  REGION 1..54: note = nuclear localization signal
PAAKRVKLDPPPPKKKRKVPGSRDISRQEIKRINKIRRRLVKDSNTKKAGKTGP

SEQ ID NO: 487 - protein, 45 aa, synthetic construct
  REGION 1..45: note = nuclear localization signal
PAAKRVKLDPGRSRDISRQEIKRINKIRRRLVKDSNTKKAGKTGP

SEQ ID NO: 488 - protein, 40 aa, synthetic construct
  REGION 1..40: note = nuclear localization signal
PKKKRKVSRDISRQEIKRINKIRRRLVKDSNTKKAGKTGP

SEQ ID NO: 489 - protein, 65 aa, synthetic construct; identical to SEQ ID NO: 478
  REGION 1..65: note = nuclear localization signal

SEQ ID NO: 490 - protein, 72 aa, synthetic construct; identical to SEQ ID NO: 481
  REGION 1..72: note = nuclear localization signal

SEQ ID NO: 491 - protein, 36 aa, synthetic construct
  REGION 1..36: note = nuclear localization signal
PKKKRKVSRQEIKRINKIRRRLVKDSNTKKAGKTGP

SEQ ID NO: 492 - protein, 66 aa, synthetic construct; identical to SEQ ID NO: 462
  REGION 1..66: note = nuclear localization signal

SEQ ID NO: 493 - protein, 86 aa, synthetic construct; identical to SEQ ID NO: 463
  REGION 1..86: note = nuclear localization signal

SEQ ID NO: 494 - protein, 38 aa, synthetic construct
  REGION 1..38: note = nuclear localization signal
PAAKRVKLDSRQEIKRINKIRRRLVKDSNTKKAGKTGP

SEQ ID NO: 495 - protein, 50 aa, synthetic construct; identical to SEQ ID NO: 464
  REGION 1..50: note = nuclear localization signal

SEQ ID NO: 496 - protein, 74 aa, synthetic construct; identical to SEQ ID NO: 465
  REGION 1..74: note = nuclear localization signal

SEQ ID NO: 497 - protein, 98 aa, synthetic construct; identical to SEQ ID NO: 466
  REGION 1..98: note = nuclear localization signal

SEQ ID NO: 498 - protein, 45 aa, synthetic construct; identical to SEQ ID NO: 468
  REGION 1..45: note = nuclear localization signal

SEQ ID NO: 499 - protein, 21 aa, synthetic construct
  REGION 1..21: note = nuclear localization signal
TSPKKKRKVALEYPYDVPDYA

SEQ ID NO: 500 - protein, 33 aa, synthetic construct
  REGION 1..33: note = nuclear localization signal
TLESKRPAATKKAGQAKKKKAPGEYPYDVPDYA

SEQ ID NO: 501 - protein, 27 aa, synthetic construct
  REGION 1..27: note = nuclear localization signal
GSKRPAATKKAGQAKKKKYPYDVPDYA

SEQ ID NO: 502 - protein, 73 aa, synthetic construct
  REGION 1..73: note = nuclear localization signal
TLESKRPAATKKAGQAKKKKGGSKRPAATKKAGQAKKKKAPGEYPYDVPDYATSPKKKRKVALEYPYDVPDYA

SEQ ID NO: 503 - protein, 98 aa, synthetic construct
  REGION 1..98: note = nuclear localization signal
TLESKRPAATKKAGQAKKKKGGSKRPAATKKAGQAKKKKGGSKRPAATKKAGQAKKKKGGSKRPAATKKAGQAKKKKTSPKKKRKVALEYPYDVPDYA

SEQ ID NO: 504 - protein, 136 aa, synthetic construct
  REGION 1..136: note = nuclear localization signal
TLESKRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKKTSPKKKRKVALEYPYDVPDYA

SEQ ID NO: 505 - protein, 74 aa, synthetic construct
  REGION 1..74: note = nuclear localization signal
TLESPKKKRKVGGSPKKKRKVGGSPKKKRKVGGSPKKKRKVTLESKRPAATKKAGQAKKKKAPGEYPYDVPDYA

SEQ ID NO: 506 - protein, 68 aa, synthetic construct
  REGION 1..68: note = nuclear localization signal
TLESPKKKRKVGGSPKKKRKVGGSPKKKRKVGGSPKKKRKVGSKRPAATKKAGQAKKKKYPYDVPDYA

SEQ ID NO: 507 - protein, 101 aa, synthetic construct
  REGION 1..101: note = nuclear localization signal
TLESPAAKRVKLDGGSPAAKRVKLDGGSPAAKRVKLDGGSPAAKRVKLDTLESKRPAATKKAGQAKKKKGGSKRPAATKKAGQAKKKKAPGEYPYDVPDYA

SEQ ID NO: 508 - protein, 150 aa, synthetic construct
  REGION 1..150: note = nuclear localization signal
TLESPAAKRVKLDGGSPAAKRVKLDGGSPAAKRVKLDGGSPAAKRVKLDGGSPAAKRVKLDGGSPAAKRVKLDTLESKRPAATKKAGQAKKKKGGSKRPAATKKAGQAKKKKGGSKRPAATKKAGQAKKKKGGSKRPAATKKAGQAKKKK

SEQ ID NO: 509 - protein, 135 aa, synthetic construct
  REGION 1..135: note = nuclear localization signal
TLESKRPAATKKAGQAKKKKTLESKRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKK

SEQ ID NO: 510 - protein, 80 aa, synthetic construct
  REGION 1..80: note = nuclear localization signal
TLESKRPAATKKAGQAKKKKGGSKRPAATKKAGQAKKKKTLESPKKKRKVGGSPKKKRKVGGSPKKKRKVGGSPKKKRKV

SEQ ID NO: 511 - protein, 54 aa, synthetic construct
  REGION 1..54: note = nuclear localization signal
TLEGGSPKKKRKVTLESPKKKRKVGGSPKKKRKVGGSPKKKRKVGGSPKKKRKV

SEQ ID NO: 512 - protein, 62 aa, synthetic construct
  REGION 1..62: note = nuclear localization signal
TLEGGSPKKKRKVTLESPAAKRVKLDGGSPAAKRVKLDGGSPAAKRVKLDGGSPAAKRVKLD

SEQ ID NO: 513 - protein, 86 aa, synthetic construct
  REGION 1..86: note = nuclear localization signal
TLEGGSPKKKRKVTLESPAAKRVKLDGGSPAAKRVKLDGGSPAAKRVKLDGGSPAAKRVKLDGGSPAAKRVKLDGGSPAAKRVKLD

SEQ ID NO: 514 - protein, 33 aa, synthetic construct
  REGION 1..33: note = nuclear localization signal
TLEGGSPKKKRKVTLESKRPAATKKAGQAKKKK

SEQ ID NO: 515 - protein, 52 aa, synthetic construct
  REGION 1..52: note = nuclear localization signal
TLEGGSPKKKRKVTLESKRPAATKKAGQAKKKKGGSKRPAATKKAGQAKKKK

SEQ ID NO: 516 - protein, 26 aa, synthetic construct
  REGION 1..26: note = nuclear localization signal
TLEGGSPKKKRKVTLEGGSPKKKRKV

SEQ ID NO: 517 - protein, 26 aa, synthetic construct
  REGION 1..26: note = nuclear localization signal
TLEGGSPKKKRKVTLEGGSPKKKRKV

SEQ ID NO: 518 - protein, 26 aa, synthetic construct
  REGION 1..26: note = nuclear localization signal
TLEGGSPKKKRKVTLEGGSPKKKRKV

SEQ ID NO: 519 - protein, 26 aa, synthetic construct
  REGION 1..26: note = nuclear localization signal
TLEGGSPKKKRKVTLEGGSPKKKRKV

SEQ ID NO: 520 - protein, 26 aa, synthetic construct
  REGION 1..26: note = nuclear localization signal
TLEGGSPKKKRKVTLEGGSPKKKRKV

SEQ ID NO: 521 - protein, 47 aa, synthetic construct
  REGION 1..47: note = nuclear localization signal
TLEVGPKRTADSQHSTPPKTKRKVEFEPKKKRKVTLEGGSPKKKRKV

SEQ ID NO: 522 - protein, 53 aa, synthetic construct
  REGION 1..53: note = nuclear localization signal
TLEVGGGSGGGSKRTADSQHSTPPKTKRKVEFEPKKKRKVTLEGGSPKKKRKV

SEQ ID NO: 523 - protein, 62 aa, synthetic construct
  REGION 1..62: note = nuclear localization signal
TLEVAEAAAKEAAAKEAAAKAKRTADSQHSTPPKTKRKVEFEPKKKRKVTLEGGSPKKKRKV

SEQ ID NO: 524 - protein, 57 aa, synthetic construct
  REGION 1..57: note = nuclear localization signal
TLEVGPPKKKRKVGGSKRTADSQHSTPPKTKRKVEFEPKKKRKVTLEGGSPKKKRKV

SEQ ID NO: 525 - protein, 45 aa, synthetic construct
  REGION 1..45: note = nuclear localization signal
TLEVGPAEAAAKEAAAKEAAAKAPAAKRVKLDTLEGGSPKKKRKV

SEQ ID NO: 526 - protein, 61 aa, synthetic construct
  REGION 1..61: note = nuclear localization signal
TLEVGPGGGSGGGSGGGSPAAKRVKLDTLEVGPKRTADSQHSTPPKTKRKVEFEPKKKRKV

SEQ ID NO: 527 - protein, 65 aa, synthetic construct
  REGION 1..65: note = nuclear localization signal
TLEVGPPKKKRKVPPPPAAKRVKLDTLEVGGGSGGGSKRTADSQHSTPPKTKRKVEFEPKKKRKV

SEQ ID NO: 528 - protein, 64 aa, synthetic construct
  REGION 1..64: note = nuclear localization signal
TLEVGPPAAKRVKLDTLEVAEAAAKEAAAKEAAAKAKRTADSQHSTPPKTKRKVEFEPKKKRKV

SEQ ID NO: 529 - protein, 78 aa, synthetic construct
  REGION 1..78: note = nuclear localization signal
TLEVGPKRTADSQHSTPPKTKRKVEFEPKKKRKVTLEVGPPKKKRKVGGSKRTADSQHSTPPKTKRKVEFEPKKKRKV

SEQ ID NO: 530 - protein, 72 aa, synthetic construct
  REGION 1..72: note = nuclear localization signal
TLEVGGGSGGGSKRTADSQHSTPPKTKRKVEFEPKKKRKVTLEVGPAEAAAKEAAAKEAAAKAPAAKRVKLD

SEQ ID NO: 531 - protein, 45 aa, synthetic construct
  REGION 1..45: note = nuclear localization signal
GSKRPAATKKAGQAKKKKTLEVGPGGGSGGGSGGGSPAAKRVKLD

SEQ ID NO: 532 - protein, 43 aa, synthetic construct
  REGION 1..43: note = nuclear localization signal
GSKRPAATKKAGQAKKKKTLEVGPPKKKRKVPPPPAAKRVKLD

SEQ ID NO: 533 - protein, 33 aa, synthetic construct
  REGION 1..33: note = nuclear localization signal
GSKRPAATKKAGQAKKKKTLEVGPPAAKRVKLD

SEQ ID NO: 534 - protein, 43 aa, synthetic construct
  REGION 1..43: note = nuclear localization signal
GSPKKKRKVTLEVGPKRTADSQHSTPPKTKRKVEFEPKKKRKV

SEQ ID NO: 535 - protein, 58 aa, synthetic construct
  REGION 1..58: note = nuclear localization signal
GSKRPAATKKAGQAKKKKTLEVGGGSGGGSKRTADSQHSTPPKTKRKVEFEPKKKRKV

SEQ ID NO: 536 - protein, 36 aa, synthetic construct
  REGION 1..36: note = nuclear localization signal
GSKRPAATKKAGQAKKKKGSKRPAATKKAGQAKKKK

SEQ ID NO: 537 - protein, 36 aa, synthetic construct; identical to SEQ ID NO: 536
  REGION 1..36: note = nuclear localization signal

SEQ ID NO: 538 - protein, 36 aa, synthetic construct; identical to SEQ ID NO: 536
  REGION 1..36: note = nuclear localization signal

SEQ ID NO: 539 - protein, 18 aa, synthetic construct
  REGION 1..18: note = nuclear localization signal
GSPKKKRKVGSPKKKRKV

SEQ ID NO: 540 - protein, 54 aa, synthetic construct
  REGION 1..54: note = nuclear localization signal
GGGSGGGSKRTADSQHSTPPKTKRKVEFEPKKKRKVGSKRPAATKKAGQAKKKK

SEQ ID NO: 541 - protein, 58 aa, synthetic construct
  REGION 1..58: note = nuclear localization signal
GPPKKKRKVGGSKRTADSQHSTPPKTKRKVEFEPKKKRKVGSKRPAATKKAGQAKKKK

SEQ ID NO: 542 - protein, 44 aa, synthetic construct
  REGION 1..44: note = nuclear localization signal
TGGGPGGGAAAGSGSPKKKRKVGSGSGSKRPAATKKAGQAKKKK

SEQ ID NO: 543 - protein, 48 aa, synthetic construct
  REGION 1..48: note = nuclear localization signal
GPKRTADSQHSTPPKTKRKVEFEPKKKRKVGSKRPAATKKAGQAKKKK

SEQ ID NO: 544 - protein, 54 aa, synthetic construct
  REGION 1..54: note = nuclear localization signal
AEAAAKEAAAKEAAAKAKRTADSQHSTPPKTKRKVEFEPKKKRKVGSPKKKRKV

SEQ ID NO: 545 - protein, 57 aa, synthetic construct
  REGION 1..57: note = nuclear localization signal
GPPKKKRKVPPPPAAKRVKLDGGGSGGGSKRTADSQHSTPPKTKRKVEFEPKKKRKV

SEQ ID NO: 546 - protein, 111 aa, synthetic construct
  REGION 1..111: note = nuclear localization signal
GSPAAKRVKLDGGSPAAKRVKLDGGSPAAKRVKLDGGSPAAKRVKLDGGSPAAKRVKLDGGSPAAKRVKLDGPPKKKRKVGGSKRTADSQHSTPPKTKRKVEFEPKKKRKV

SEQ ID NO: 547 - protein, 67 aa, synthetic construct
  REGION 1..67: note = nuclear localization signal
GSPAAKRVKLGGSPAAKRVKLGGSPKKKRKVGGSPKKKRKVTGGGPGGGAAAGSGSPKKKRKVGSGS

SEQ ID NO: 548 - protein, 67 aa, synthetic construct
  REGION 1..67: note = nuclear localization signal
GSKRPAATKKAGQAKKKKGGSKRPAATKKAGQAKKKKGPKRTADSQHSTPPKTKRKVEFEPKKKRKV

SEQ ID NO: 549 - protein, 82 aa, synthetic construct
  REGION 1..82: note = nuclear localization signal
GSKRPAATKKAGQAKKKKGGSKRPAATKKAGQAKKKKAEAAAKEAAAKEAAAKAKRTADSQHSTPPKTKRKVEFEPKKKRKV

SEQ ID NO: 550 - protein, 21 aa, synthetic construct
  REGION 1..21: note = nuclear localization signal
GPPKKKRKVPPPPAAKRVKLD

SEQ ID NO: 551 - protein, 71 aa, synthetic construct
  REGION 1..71: note = nuclear localization signal
GSPAAKRVKLDGGSPAAKRVKLDGGSPAAKRVKLDGGSPAAKRVKLDGGSPAAKRVKLDGGSPAAKRVKLD

SEQ ID NO: 552 - protein, 41 aa, synthetic construct
  REGION 1..41: note = nuclear localization signal
GSPAAKRVKLGGSPAAKRVKLGGSPKKKRKVGGSPKKKRKV

SEQ ID NO: 553 - protein, 37 aa, synthetic construct
  REGION 1..37: note = nuclear localization signal
GSKRPAATKKAGQAKKKKGGSKRPAATKKAGQAKKKK

SEQ ID NO: 554 - protein, 37 aa, synthetic construct; identical to SEQ ID NO: 553
  REGION 1..37: note = nuclear localization signal

SEQ ID NO: 555 - protein, 11 aa, synthetic construct
  REGION 1..11: note = peptide transduction domain
YGRKKRRQRRR

SEQ ID NO: 556 - protein, 8 aa, synthetic construct
  REGION 1..8: note = peptide transduction domain
RKKRRQRR

SEQ ID NO: 557 - protein, 11 aa, synthetic construct
  REGION 1..11: note = peptide transduction domain
YARAAARQARA

SEQ ID NO: 558 - protein, 11 aa, synthetic construct
  REGION 1..11: note = peptide transduction domain
THRLPRRRRRR

SEQ ID NO: 559 - protein, 50 aa, synthetic construct
  REGION 1..50: note = peptide transduction domain
  VARIANT 4..50: note = individual amino acid residues may be present or absent
RRRRRRRRRRRRRRRRRRRRRRRRRRRRRRRRRRRRRRRRRRRRRRRRRR

SEQ ID NO: 560 - protein, 12 aa, synthetic construct
  REGION 1..12: note = peptide transduction domain
RRQRRTSKLMKR

SEQ ID NO: 561 - protein, 27 aa, synthetic construct
  REGION 1..27: note = peptide transduction domain
GWTLNSAGYLLGKINLKALAALAKKIL

SEQ ID NO: 562 - protein, 33 aa, synthetic construct
  REGION 1..33: note = peptide transduction domain
KALAWEAKLAKALAKALAKHLAKALAKALKCEA

SEQ ID NO: 563 - protein, 16 aa, synthetic construct
  REGION 1..16: note = peptide transduction domain
RQIKIWFQNRRMKWKK

SEQ ID NO: 564 - skipped

SEQ ID NO: 565 - DNA, 20 bp, synthetic construct
  misc_feature 1..20: note = scaffold stem loop
  source 1..20: mol_type = other DNA
ccagcgactatgtcgtatgg

SEQ ID NO: 566 - DNA, 39 bp, synthetic construct
  misc_feature 1..39: note = extended stem loop
  source 1..39: mol_type = other DNA
gcgcttatttatcggagagaaatccgataaataagaagc

SEQ ID NO: 567 - RNA, 26 nt, synthetic construct
  misc_feature 1..26: note = crRNA sequence
  source 1..26: mol_type = other RNA
tctccgataaataagaagcatcaaag

SEQ ID NO: 568 - RNA, 21 nt, synthetic construct
  misc_feature 1..21: note = scaffold stem loop
  source 1..21: mol_type = other RNA
ccagcgactatgtcgtagtgg

SEQ ID NO: 569 - RNA, 31 nt, synthetic construct
  misc_feature 1..31: note = packaging element
  source 1..31: mol_type = other RNA
tgggcgcagcgtcaatgacgctgacggtaca

SEQ ID NO: 570 - RNA, 66 nt, synthetic construct
  misc_feature 1..66: note = packaging element
  source 1..66: mol_type = other RNA
gcactatgggcgcagcgtcaatgacgctgacggtacaggccagacaattattgtctggtatagtgc

SEQ ID NO: 571 - RNA, 167 nt, synthetic construct
  misc_feature 1..167: note = packaging element
  source 1..167: mol_type = other RNA
caggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctg

SEQ ID NO: 572 - RNA, 234 nt, synthetic construct
  misc_feature 1..234: note = packaging element
  source 1..234: mol_type = other RNA
aggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcct

SEQ ID NO: 573 - protein, 511 aa, Vesicular Stomatitis Virus
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 574 - protein, 856 aa, Human immunodeficiency virus
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQIWNHTTWMEWDREINNYTSLIHSLIEESQNQQEKNEQELLELDKWASLWNWFNITNWLWYIKLFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 575 - protein, 606 aa, Avian leukosis virus
MEAVIKAFLTGYPGKTSKKDSKEKPLATSKKDPEKTPLLPTRVNYILIIGVLVLCEVTGVRADVHLLEQPGNLWITWANRTGQTDFCLSTQSATSPFQTCLIGIPSPISEGDFKGYVSDNCTTLGTDRLVSSADFTGGPDNSTTLTYRKVSCLLLKLNVSMWDEPHELQLLGSQSLPNITNIAQISGITGGCVGFRPQGVPWYLGWSRQEATRFLLRHPSFSKSTEPFTVVTADRHNLFMGSEYCGAYGYRFWNMYNCSQVGRQYRCGNARSPRPGLPEIQCTRRGGKWVNQSQEINESEPFSFTVNCTASSLGNASGCCGKAGTILPGKWVDSTQGSFTKPKALPPAIFLICGDRAWQGIPSRPVGGPCYLGKLTMLAPKHTDILKVLVNSSRTGIRRKRSTSHLDDTCSDEVQLWGPTARIFASILAPGVAAAQALREIERLACWSVKQANLTTSLLGDLLDDVTSIRHAVLQNRAAIDFLLLAHGHGCEDVAGMCCFNLSDHSESIQKKFQLMKEHVNKIGVDSDPIGSWLRGLFGGIGEWAVHLLKGLLLGLVVILLLVVCLPCLLQIVCGNIRKMINNSISYHTEYKKLQKACGQPESRIV

SEQ ID NO: 576 - protein, 601 aa, Rous Sarcoma Virus
MEAVIKAFLTGYPGKTSKKDSKEKPLATSKKDPEKTPLLPTRVNYILIIGVLVLCEVTGVRADVHLLEQPGNLWITWANRTGQTDFCLSTQSATSPFQTCLIGIPSPISEGDFKGYVSDTNCSTVGTDRLVLSASITGGPDNSTTLTYRKVSCLLLKLNVSMWDEPPELQLLGSQSLPNVTNITQVSGVAGGCVYFAPRATGLFLGWSKQGLSRFLLRHPFTSTSNSTEPFTVVTADRHNLFMGSEYCGAYGYRFWEIYNCSQTRNTYRCGDVGGTGLPETWCRGKGGIWVNQSKEINETEPFSFTANCTGSNLGNVSGCCGEPITILPLGAWIDSTQGSFTKPKALPPAIFLICGDRAWQGIPSRPVGGPCYLGKLTMLAPNHTDILKILANSSRTGIRRKRSVSHLDDTCSDEVQLWGPTARIFASILAPGVAAAQALREIERLACWSVKQANLTTSLLGDLLDDVTSIRHAVLQNRAAIDFLLLAHGHGCEDVAGMCCFNLSDHSESIQKKFQLMKKHVNKIGVDSDPIGSWLRGIFGGIGEWAVHLLKGLLLGLVVILLLLVCLPCLLQFVSSSIRKMINSSINYHTEYRKMQGGAV

SEQ ID NO: 577 - protein, 688 aa, Mouse mammary tumor virus
MPKHQSGSPTDSSDLLLSGKKQRPHLALRRKRRREMRKINRKVPRMNLVPIKEKTAWQHLQALISEAEEVLKTSQTPQTSLTLFLALLSVLGPPPVTGESYWAYLPKPPILHPVGWGSTDPIRVLTNQTMYLGGSPDFHGFRNMSGNVHFEGKSDTLPICLSFSFSTPTGCFQVDKQVFLSDTPTVDNNKPGGKGDKRRMWELWLTTLGNSGANTKLVPIKKKLPPKYPHCQIAFKKDAFWEGDESAPPRWLPCAFPDQGVSFSPKGALGLLWDFSLPSPSVDQSDQIKSKKNLFGNYTPPVNKEVHRWYEAGWVEPTWFWENSPKDPNDRDFTALVPHTELFRLVAASRHLILKRPGFQEHEMIPTSACVTYPYAILLGLPQLIDIEKRGSTFHISCSSCRLTNCLDSSAYDYAAIIVKRPPYVLLPVDIGDEPWFDDSAIQTFRYATDLIRAKRFVAAIILGISALIAIITSFAVATTALVKEMQTATFVNNLHRNVTLALSEQRIIDLKLEARLNALEEVVLELGQDVANLKTRMSTRCHANYDFICVTPLPYNATENWERTRAHLLGIWNDNEISYNIQELTNLISDMSKQHIDAVDLSGLAQSFANGVKALNPLDWTQYFIFIGVGALLLVIVLMIFPIVFQCLAKSLDQVQSDLNVLLLKKKKGGNAAPAAEMVELPRVSYT

SEQ ID NO: 578 - protein, 488 aa, Human T-cell lymphotropic virus 1
MGKFLATLILFFQFCPLIFGDYSPSCCTLTIGVSSYHSKPCNPAQPVCSWTLDLLALSADQALQPPCPNLVSYSSYHATYSLYLFPHWTKKPNRNGGGYYSASYSDPCSLKCPYLGCQSWTCPYTGAVSSPYWKFQHDVNFTQEVSRLNINLHFSKCGFPFSLLVDAPGYDPIWFLNTEPSQLPPTAPPLLPHSNLDHILEPSIPWKSKLLTLVQLTLQSTNYTCIVCIDRASLSTWHVLYSPNVSVPSSSSTPLLYPSLALPAPHLTLPFNWTHCFDPQIQAIVSSPCHNSLILPPFSLSPVPTLGSRSRRAVPVAVWLVSALAMGAGVAGGITGSMSLASGKSLLHEVDKDISQLTQAIVKNHKNLLKIAQYAAQNRRGLDLLFWEQGGLCKALQEQCRFPNITNSHVPILQERPPLENRVLTGWGLNWDLGLSQWAREALQTGITLVALLLLVILAGPCILRQLRHLPSRVRYPHYSLIKPESSL

SEQ ID NO: 579 - protein, 565 aa, RD114 retrovirus
MKLPTGMVILCSLIIVRAGFDDPRKAIALVQKQHGKPCECSGGQVSEAPPNSIQQVTCPGKTAYLMTNQKWKCRVTPKNLTPSGGELQNCPCNTFQDSMHSSCYTEYRQCRANNKTYYTATLLKIRSGSLNEVQILQNPNQLLQSPCRGSINQPVCWSATAPIHISDGGGPLDTKRVWTVQKRLEQIHKAMHPELQYHPLALPKVRDDLSLDARTFDILNTTFRLLQMSNFSLAQDCWLCLKLGTPTPLAIPTPSLTYSLADSLANASCQIIPPLLVQPMQFSNSSCLSSPFINDTEQIDLGAVTFTNCTSVANVSSPLCALNGSVFLCGNNMAYTYLPQNWTGLCVQASLLPDIDIIPGDEPVPIPAIDHYIHRPKRAVQFIPLLAGLGITAAFTTGATGLGVSVTQYTKLSHQLISDVQVLSGTIQDLQDQVDSLAEVVLQNRRGLDLLTAEQGGICLALQEKCCFYANKSGIVRNKIRTLQEELQKRRESLASNPLWTGLQGFLPYLLPLLGPLLTLLLILTIGPCVFSRLMAFINDRLNVVHAMVLAQQYQALKAEEEAQD

SEQ ID NO: 580 - protein, 685 aa, Gibbon leukemia virus
MVLLPGSMLLTSSLHHLRHQMSPGSWKRLIILLSCVFGGGGTSLQNKNPHQPMTLTWQVLSQTGDVVWDTKAVQPPWTWWPTLKPDICALAAGLESWDIPGTDVSSSKRVRPPDSDYTAAYKQITWGAIGCSYPRARTRMASSTFYVCPRDGRTPSEARRCGGLESLYCKEWNCETTGTGYWLPKSSKDLITGRWDQNSKWDQKFQKCHQTGWCNPLKIDFTDTGKSSRDWIVGKTWGLRFYVHGHPGVQFTIRLKITSMTAVAVGPDPVLVEQGPPRRALALPPPLPPREAPPPPLPDSNSTTLATSAQTPTVGKTIVTLNTPPPTTGDRLFNLVQGAFLTLNATNPGATKSCWLCLAMGPPYYEAITSLGEVAYSTSQDRCHWGTQGKLTLTEVSGHGLCIGKVPFTHQHLCNQTLSINSSEGHQYLLPSNHSWWACSTGLTPCLSTSVFNQSRDFCIQVQLIPRIYYYPEEVLLQAYDDSHPRPKREAVSLTLAVLLGLGITAGIGTGSTALIKGPIDLQQGLTSLQIAIDADLRALQDSVSKLEDSLTSLSEVVLQNRRGLDLLFLKEGGLCAALKEECCFYIDHSGAVRDSMKKLKEKLDKRQLERQKNQNWYEGWFNNSPWFTTLLSTIAGPLLLLLLLLILGPCIINKLVQFINDRVSAVKILVLRTKYQALDNEDNL

SEQ ID NO: 581 - protein, 665 aa, Murine leukemia virus
MARSTLSKPLKNKVNPRGPLIPLILLMLRGVSTASPGSSPHQVYNITWEVTNGDRETVWATSGNHPLWTWWPDLTPDLCMLAHHGPSYWGLEYQSPFSSPPGPPCCSGGSSPGCSRDCEEPLTSLTPRCNTAWNRLKLDQTTHKSNEGFYVCPGPHRPRESKSCGGPDSFYCAYWGCETTGRAYWKPSSSWDFITVNNNLTSDQAVQVCKDNKWCNPLVIRFTDAGRRVTSWTTGHYWGLRLYVSGQDPGLTFGIRLRYQNLGPRVPIGPNPVLADQQPLSKPKPVKSPSVTKPPSGTPLSPTQLPPAGTENRLLNLVDGAYQALNLTSPDKTQECWLCLVAGPPYYEGVAVLGTYSNHTSAPANCSVASQHKLTLSEVTGQGLCIGAVPKTHQALCNTTQTSSRGSYYLVAPTGTMWACSTGLTPCISTTILNLTTDYCVLVELWPRVTYHSPSYVYGLFERSNRHKREPVSLTLALLLGGLTMGGIAAGIGTGTTALMATQQFQQLQAAVQDDLREVEKSISNLEKSLTSLSEVVLQNRRGLDLLFLKEGGLCAALKEECCFYADHTGLVRDSMAKLRERLNQRQKLFESTQGWFEGLFNRSPWFTTLISTIMGPLIVLLMILLFGPCILNRLVQFVKDRISVVQALVLTQQYHQLKPIEYEP

SEQ ID NO: 582 - protein, 563 aa, Baboon Endogenous Virus
MGFTTKIIFLYNLVLVYAGFDDPRKAIELVQKRYGRPCDCSGGQVSEPPSDRVSQVTCSGKTAYLMPDQRWKCKSIPKDTSPSGPLQECPCNSYQSSVHSSCYTSYQQCRSGNKTYYTATLLKTQTGGTSDVQVLGSTNKLIQSPCNGIKGQSICWSTTAPIHVSDGGGPLDTTRIKSVQRKLEEIHKALYPELQYHPLAIPKVRDNLMVDAQTLNILNATYNLLLMSNTSLVDDCWLCLKLGPPTPLAIPNFLLSYVTRSSDNISCLIIPPLLVQPMQFSNSSCLFSPSYNSTEEIDLGHVAFSNCTSITNVTGPICAVNGSVFLCGNNMAYTYLPTNWTGLCVLATLLPDIDIIPGDEPVPIPAIDHFIYRPKRAIQFIPLLAGLGITAAFTTGATGLGVSVTQYTKLSNQLISDVQILSSTIQDLQDQVDSLAEVVLQNRRGLDLLTAEQGGICLALQEKCCFYVNKSGIVRDKIKTLQEELERRRKDLASNPLWTGLQGLLPYLLPFLGPLLTLLLLLTIGPCIFNRLTAFINDKLNIIHAMVLTQQYQVLRTDEEAQD

SEQ ID NO: 583 - protein, 985 aa, Human Foamy Virus
MTLQQWIIWKKMNKAHEALQNTTTVTEQQKEQIILDIQNEEVQPTRRDKFRYLLYTCCATSSRVLAWMFLVCILLIIVLVSCFVTISRIQWNKDIQVLGPVIDWNVTQRAVYQPLQTRRIARSLRMQHPVPKYVEVNMTSIPQGVYYEPHPEPIVVKERVLGLSQILMINSENIANNANLTQEVKKLLTEMVNEEMQSLSDVMIDFEIPLGDPRDQEQYIHRKCYQEFANCYLVKYKEPKPWPKEGLIADQCPLPGYHAGLTYNRQSIWDYYIKVESIRPANWTTKSKYGQARLGSFYIPSSLRQINVSHVLFCSDQLYSKWYNIENTIEQNERFLLNKLNNLTSGTSVLKKRALPKDWSSQGKNALFREINVLDICSKPESVILLNTSYYSFSLWEGDCNFTKDMISQLVPECDGFYNNSKWMHMHPYACRFWRSKKNEKEETKCRDGETKRCLYYPLWDSPESTYDFGYLAYQKNFPSPICIEQQKIRDQDYEVYSLYQERKIASKAYGIDTVLFSLKNFLNYTGTPVNEMPNARAFVGLIDPKFPPSYPNVTREHYTSCNNRKRRSVDNNYAKLRSMGYALTGAVQTLSQISDINDENLQQGIYLLRDHVITLMEATLHDISVMEGMFAVQHLHTHLNHLKTMLLERRIDWTYMSSTWLQQQLQKSDDEMKVIKRIARSLVYYVKQTHSSPTATAWEIGLYYELVIPKHIYLNNWNVVNIGHLVKSAGQLTHVTIAHPYEIINKECVETIYLHLEDCTRQDYVICDVVKIVQPCGNSSDTSDCPVWAEAVKEPFVQVNPLKNGSYLVLASSTDCQIPPYVPSIVTVNETTSCFGLDFKRPLVAEERLSFEPRLPNLQLRLPHLVGIIAKIKGIKIEVTSSGESIKEQIERAKAELLRLDIHEGDTPAWIQQLAAATKDVWPAAASALQGIGNFLSGTAQGIFGTAFSLLGYLKPILIGVGVILLVILIFKIVSWIPTKKKNQ

SEQ ID NO: 584 - protein, 913 aa, Psuedorabies virus
MPAGGGLWRGPRGHRPGHHGGAGLGRLWPAPHHAAAARGAVALALLLLALAAAPPCGAAAVTRAASASPTPGTGATPNDVSAEASLEEIEAFSPGPSEAPDGEYGDLDARTAVRAAATERDRFYVCPPPSGSTVVRLEPEQACPEYSQGRNFTEGIAVLFKENIAPHKFKAHIYYKNVIVTTVWSGSTYAAITNRFTDRVPVPVQEITDVIDRRGKCVSKAEYVRNNHKVTAFDRDENPVEVDLRPSRLNALGTRGWHTTNDTYTKIGAAGFYHTGTSVNCIVEEVEARSVYPYDSFALSTGDIVYMSPFYGLREGAHGEHIGYAPGRFQQVEHYYPIDLDSRLRASESVTRNFLRTPHFTVAWDWAPKTRRVCSLAKWREAEEMTRDETRDGSFRFTSRALGASFVSDVTQLDLQRVHLGDCVLREASEAIDAIYRRRYNSTHVLAGDRPEVYLARGGFVVAFRPLISNELAQLYARELERLGLAGVVGPAAPAAARRARRSPGPAGTPEPPAVNGTGHLRITTGSAEFARLQFTYDHIQAHVNDMLGRIAAAWCELQNKDRTLWSEMSRLNPSAVATAALGQRVSARMLGDVMAISRCVEVRGGVYVQNSMRVPGERGTCYSRPLVTFEHNGTGVIEGQLGDDNELLISRDLIEPCTGNHRRYFKLGSGYVYYEDYNYVRMVEVPETISTRVTLNLTLLEDREFLPLEVYTREELADTGLLDYSEIQRRNQLHALKFYDIDRVVKVDHNVVLLRGIANFFQGLGDVGAAVGKVVLGATGAVISAVGGMVSFLSNPFGALAIGLLVLAGLVAAFLAYRHISRLRRNPMKALYPVTTKTLKEDGVDEGDVDEAKLDQARDMIRYMSIVSALEQQEHKARKKNSGPALLASRVGAMATRRRHYQRLESEDPDAL

SEQ ID NO: 585 - protein, 400 aa, Psuedorabies virus
MLLAALLAALVARTTLGADVDAVPAPTFPPPAYPYTESWQLTLTTVPSPFVGPADVYHTRPLEDPCGVVALISDPQVDRLLNEAVAHRRPTYRAHVAWYRIADGCAHLLYFIEYADCDPRQIFGRCRRRTTPMWWTPSADYMFPTEDELGLLMVAPGRFNEGQYRRLVSVDGVNILTDFMVALPEGQECPFARVDQHRTYKFGACWNDESFRRGVDVMRFLTPFYQQPPHREVVNYWYRKNGRTLPRAYAAATPYAIDPARPSAGSPRPRPRPRPRPKPEPAPVTPAPPGRLPEPATRDHAAGGHPTPRPPRPETPHRPFAPPAVVPSGWPQPAEPFQPRTPAAPGVSRHRSVIVGTGTAMGALLVGVCVYIFFRLRGAKGYRLLGGPADTDELKAQPGP

SEQ ID NO: 586 - protein, 686 aa, Psuedorabies virus
MPASSVRLPLRLLTLAGLLALAGAAALARGAPQGGPPSPQGGPAPTAAPARGPTLFVLVGDGSAWFVFQLGGLGALNDTRIRGHLLGRYLVSYQVVPPPVSAWYFVQRPRERPRLSGPPSGAELVAFDAPGVRRTYTTAAVWPAEVAVLADAEARCPAAVFNVTLGEAFLGLRVALRSFLPLEVIISAERMRMIAPPALGSDLEPPGPPAGRFHVYTLGFLSDGAMHQTMRDVAAYVHESDDYLAQLSAAHAAALAAVVQPGPYYFYRAAVRLGVAAFVFSEAARRDRRASAPALLRVESDARLLSRLLMRAAGCPAGFAGLFDGRAERVPVAPADQLRAAWTFGEDPAPRLDLARATVAEAYRRSVRGKPFDQQALFFAVALLLRAGGPGDARETLLRTTAMCTAERAAAAAELTRAALSPTAAWNEPFSLLDVLSPCAVSLRRDLGGDATLANLGAAARLALAPAGAPGAAAATDEGAEEEEEDPVARAAPEIPAEALLALPLRGGASFVFTRRRPDCGPAYTLGGVDIANPLVLAIVSNDSAACDYTDRMPESQHLPATDNPSVCVYCDCVFVRYSSAGTILETVLIESKDMEEQLMAGANSTIPSFNPTLHGGDVKALMLFPNGTVVDLLSFTSTRLAPVSPAYVVASVVGAAITVGILYALFKMLCSFSSEGYSRLINARS

SEQ ID NO: 587 - protein, 156 aa, Psuedorabies virus
MSPLVAVLVFFSAALGIPGPGVAGNPRGLDAIFEAPVTPAPPTRHPRREELEWDDEDHPLLDLEPPVGSRCHPYIAYSLPPDMNAVTSVVVKPYCSPPEVILWASGTAYLVNPFVAIQALAVGEPLNEAALKELGEVAVHKDSLPPLRYNGGPPAE

SEQ ID NO: 588 - protein, 904 aa, unidentified
  REGION 1..904: note = Herpes simplex virus 1 (HHV1)
MRQGAPARGRRWFVVWALLGLTLGVLVASAAPSSPGTPGVAAATQAANGGPATPAPPAPGAPPTGDPKPKKNKKPKPPKPPRPAGDNATVAAGHATLREHLRDIKAENTDANFYVCPPPTGATVVQFEQPRRCPTRPEGQNYTEGIAVVFKENIAPYKFKATMYYKDVTVSQVWFGHRYSQFMGIFEDRAPVPFEEVIDKINAKGVCRSTAKYVRNNLETTAFHRDDHETDMELKPANAATRTSRGWHTTDLKYNPSRVEAFHRYGTTVNCIVEEVDARSVYPYDEFVLATGDFVYMSPFYGYREGSHTEHTSYAADRFKQVDGFYARDLTTKARATAPTTRNLLTTPKFTVAWDWVPKRPSVCTMTKWQEVDEMLRSEYGGSFRFSSDAISTTFTTNLTEYPLSRVDLGDCIGKDARDAMDRIFARRYNATHIKVGQPQYYLANGGFLIAYQPLLSNTLAELYVREHLREQSRKPPNPTPPPPGASANASVERIKTTSSIEFARLQFTYNHIQRHVNDMLGRVAIAWCELQNHELTLWNEARKLNPNAIASATVGRRVSARMLGDVMAVSTCVPVAADNVIVQNSMRISSRPGACYSRPLVSFRYEDQGPLVEGQLGENNELRLTRDAIEPCTVGHRRYFTFGGGYVYFEEYAYSHQLSRADITTVSTFIDLNITMLEDHEFVPLEVYTRHEIKDSGLLDYTEVQRRNQLHDLRFADIDTVIHADANAAMFAGLGAFFEGMGDLGRAVGKVVMGIVGGVVSAVSGVSSFMSNPFGALAVGLLVLAGLAAAFFAFRYVMRLQSNPMKALYPLTTKELKNPTNPDASGEGEEGGDFDEAKLAEAREMIRYMALVSAMERTEHKAKKKGTSALLSAKVTDMVMRKRRNTNYTQVPNKDGDADEDDL

SEQ ID NO: 589 - protein, 394 aa, unidentified
  REGION 1..394: note = Herpes simplex virus 1 (HHV1)
MGGAAARLGAVILFVVIVGLHGVRSKYALVDASLKMADPNRFRGKDLPVLDQLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQIPPNWHIPSIQDAATPYHPPATPNNMGLIAGAVGGSLLAALVICGIVYWMRRHTQKAPKRIRLPHIREDDQPSSHQPLFY

SEQ ID NO: 590 - protein, 838 aa, unidentified
  REGION 1..838: note = Herpes simplex virus 1 (HHV1)
MGNGLWFVGVIILGVAWGQVHDWTEQTDPWFLDGLGMDRMYWRDTNTGRLWLPNTPDPQKPPRGFLAPPDELNLTTASLPLLRWYEERFCFVLVTTAEFPRDPGQLLYIPKTYLLGRPPNASLPAPTTVEPTAQPPPSVAPLKGLLHNPVASVLLRSRAWVTFSAVPDPEALTFPRGDNVATASHPSGPRDTPPPRPPVGARRHPTTELDITHLHNASTTWLATRGLLRSPGRYVYFSPSASTWPVGIWTTGELVLGCDAALVRARYGREFMGLVISMHDSPPVEVMVVPAGQTLDRVGDPADENPPGALPGPPGGPRYRVFVLGSLTRADNGSALDALRRVGGYPEEGTNYAQFLSRAYAEFFSGDAGAEQGPRPPLFWRLTGLLATSGFAFVNAAHANGAVCLSDLLGFLAHSRALAGLAARGAAGCAADSVFFNVSVLDPTARLQLEARLQHLVAEILEREQSLALHALGYQLAFVLDSPSAYDAVAPSAAHLIDALYAEFLGGRVLTTPVVHRALFYASAVLRQPFLAGVPSAVQRERARRSLLIASALCTSDVAAATNADLRTALARADHQKTLFWLPDHFSPCAASLRFDLDESVFILDALAQATRSETPVEVLAQQTHGLASTLTRWAHYNALIRAFVPEASHRCGGQSANVEPRILVPITHNASYVVTHSPLPRGIGYKLTGVDVRRPLFLTYLTATCEGSTRDIESKRLVRTQNQRDLGLVGAVFMRYTPAGEVMSVLLVDTDNTQQQIAAGPTEGAPSVFSSDVPSTALLLFPNGTVIHLLAFDTQPVAAIAPGFLAASALGVVMITAALAGILKVLRTSVPFFWRRE

SEQ ID NO: 591 - protein, 224 aa, unidentified
  REGION 1..224: note = Herpes simplex virus 1 (HHV1)
MGILGWVGLIAVGVLCVRGGLPSTEYVIRSRVAREVGDILKVPCVPLPSDDLDWRYETPSAINYALIDGIFLRYHCPGLDTVLWDRHAQKAYWVNPFLFVAGFLEDLSYPAFPANTQETETRLALYKEIRQALDSRKQAASHTPVKAGCVNFDYSRTRRCVGRQDLGPTNGTSGRTPVLPPDDEAGLQPKPLTTPPPIIATSDPTPRRDAATKSRRRRPHSRRL

SEQ ID NO: 592 - protein, 581 aa, Hepatitis C Virus
MGCSFSIFLLALLSCLTVPASAVEVRNVSSSYYATNDCSNSSITWQLNNAVLHLPGCVPCENDNGTLHCWIQVTPNVAVKHRGALTHNLRTHVDMIVMAATVCSALYVGDMCGAVMIVSQALIISPERHNFTQECNCSIYQGHITGHRMAWDMMLNWSPTLTMILAYAARVPELVLEVVFGGHWGVVFGLAYFSMQGAWAKVIAILLLVAGVDAETHTTGSAAGHAARGFANLLSPGSKQKISLINTNGSWHINRTALNCNDSLQTGFLASLFYVNNFNSSGCPERMSSCRGLDDFRIGWGTLEYETNVTNEEDMRPYCWHYPPKPCGIISARTVCGPVYCFTPSPVVVGTTDEQGLPTYSWGENETDVFLLNSTRPPQGAWFGCTWMNGTGFTKTCGAPPCRIRRDFNSTLDLLCPTDCFRKHPDTTYLKCGAGPWLTPRCLVDYPYRLWHYPCTVNFTIFKVRMYVGGVEHRLSAACNFTRGDRCRLEDRDRGQQSPLLHSTTEWAVLPCSFSDLPALSTGLLHLHQNIVDVQYLYGLTPAITKYIVKWEWVVLLFLLLADARVCACLWMLIILGQAEA

SEQ ID NO: 593 - protein, 524 aa, Rabies Virus
MVPQALLFVPLLVFPLCFGKFPIYTIPDKLGPWSPIDIHHLSCPNNLVVEDEGCTNLSGFSYMELKVGYILAIKVNGFTCTGVVTEAETYTNFVGYVTTTFKRKHFRPTPDACRAAYNWKMAGDPRYEESLHNPYPDYRWLRTVKTTKESLVIISPSVADLDPYDRSLHSRVFPSGKCSGVAVSSTYCSTNHDYTIWMPENPRLGMSCDIFTNSRGKRASKGSETCGFVDERGLYKSLKGACKLKLCGVLGLRLMDGTWVSMQTSNETKWCPPDKLVNLHDFRSDEIEHLVVEELVRKREECLDALESIMTTKSVSFRRLSHLRKLVPGFGKAYTIFNKTLMEADAHYKSVRTWNEILPSKGCLRVGGRCHPHVNGVFFNGIILGPDGNVLIPEMQSSLLQQHMELLESSVIPLVHPLADPSTVFKDGDEAEDFVEVHLPDVHNQVSGVDLGLPNWGKYVLLSAGALTALMLIIFLMTCCRRVNRSEPTQHNLRGTGREVSVTPQSGKIISSWESHKSGGETRL

SEQ ID NO: 594 - protein, 522 aa, Mokola Virus
MNIPCFVVILSLATTHSLGEFPLYTIPEKIEKWTPIDMIHLSCPNNLLSEEEGCNAESSFTYFELKSGYLAHQKVPGFTCTGVVNEAETYTNFVGYVTTTFKRKHFRPTVAACRDAYNWKVSGDPRYEESLHTPYPDSSWLRTVTTTKESLLIISPSIVEMDIYGRTLHSPMFPSGVCSNVYPSVPSCETNHDYTLWLPEDPSLSLVCDIFTSSNGKKAMNGSRICGFKDERGFYRSLKGACKLTLCGRPGIRLFDGTWVSFTKPDVHVWCTPNQLINIHNDRLDEIEHLIVEDIIKKREECLDTLETILMSQSVSFRRLSHFRKLVPGYGKAYTILNGSLMETNVYYKRVDKWADILPSKGCLKVGQQCMEPVKGVLFNGIIKGPDGQILIPEMQSEQLKQHMDLLKAAVFPLRHPLISREAVFKKDGDADDFVDLHMPDVHKSVSDVDLGLPHWGFWMLIGATIVAFVVLVCLLRVCCKRVRRRRSGRATQEIPLSFPSAPVPRAKVVSSWESYKGLPGT

SEQ ID NO: 595 - protein, 550 aa, Measles Virus
MGLKASVSAIFMTVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIETIRQAGQEMILAVQGIQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADYCPVVEVNGVTIQVGSRKYPDAVYLHRIDLGPPISLERLDVGTNLGNAVAKLEDAKELLESSDQILRSMKGLSSTNIVYILIAVCLGGLIGIPTLICCCRGRCNKKGGQVGMSRPGLKPDLTGTSKSYVRSL

SEQ ID NO: 596 - protein, 617 aa, Measles Virus
MSPQRDRINAFYKDNPHPKGSRIVINREHLMIDRPYVLLAVLFVMFLSLIGLLAIAGIRLHRAAIYTAEIHKSLSTNLDVTNSIEHQVKDVLTPLFKIIGDEVGLRTPQRFTDLVKFISDKIKFLNPDREYDFRDLTWCINPPERIKLDYDQYCADVAAEELMNALVNSTLLETRTTNQFLAVSKGNCSGPTTIRGQFSNMSLSLLDLYLSRGYNVSSIVTMTSQGMYGGTYLVEKPNLSSKGSELPQPSMHRVFEVGVIRNPGLGAPVFHMTNYFEQPVSNDFSNCMVALGELKLAALCHGEDSITIPYQGSGKGVSFQLVKLGVWKSPTDMQSWVPLSTDDPVIDRLYLSSHRGIIADNQAKWAVPTTRTDDKLRMETCFQQACKGKIQALCENPEWAPLKDNRIPSYGVLSVDLSLAVELKIKIASGFGPLITHGSGMDLYKSNHNNVYWLTIPPMKNLALGVINTLEWIPRFKVSPNLFTVPIKEAGEDCHAPTYLPAEVDGDVKLSSNLVILPGQDLQYVLATYDTSRVEHAVVYYVYSPSRSFSYFYPFRLPIKGVPIELQVECFTWDQKLWCRHFCVLADSESGGHITHSGMVGMGVSCTVTREDGTNRG

SEQ ID NO: 597 - protein, 676 aa, unidentified
  REGION 1..676: note = Ebola Zaire Virus
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIPAGIGVTGVIIAVIALFCICKFVF

SEQ ID NO: 598 - protein, 495 aa, Dengue virus
MRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQA

SEQ ID NO: 599 - protein, 505 aa, unidentified
  REGION 1..505: note = Zika virus
MIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 600 - protein, 427 aa, West Nile Virus
MFNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGPTTVESHGNYSTQVGATQAGRFSITPAAPSYTLKLGEYGEVTVDCEPRSGIDTNAYYVMTVGTKTFLVHREWFMDLNLPWSSAGSTVWRNRETLMEFEEPHATKQSVIALGSQEGALHQALAGAIPVEFSSNTVKLTSGHLKCRVKMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGKAFTTTLKGAQRLAALGDTAW

SEQ ID NO: 601 - protein, 501 aa, Japanese Encephalitis Virus
MFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGLFGKGSIDTCAKFSCTSKAIGRTIQPENIKYEVGIFVHGTTTSENHGNYSAQVGASQAAKFTVTPNAPSITLKLGDYGEVTLDCEPRSGLNTEAFYVMTVGSKSFLVHREWFHDLALPWTSPSSTAWRNRELLMEFEEAHATKQSVVALGSQEGGLHQALAGAIVVEYSSSVKLTSGHLKCRLKMDKLALKGTTYGMCTGKFSFAKNPADTGHGTVVIELSYSGRDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHA

SEQ ID NO: 602 - protein, 717 aa, unidentified
  REGION 1..717: note = Hepatitis G Virus
MSLLTNRFIRRVDKDQWGPGVMGKDPKPCPSRWAGKCMGPPSSAAACSRGSPRILRVRAGGISLFYTIMAVLLLLLVVEAGAILAPATHACRANGQYFLTNCCAPEDIGFCLEGGCLVALGCTVCTDRCWPLYQAGLAVRPGKSAAQLVGELGSLYGPLSVSAYVAGILGLGEVYSGVLTVGVALRRRVYLMPNLKCAVECDVKWGSEFWRWTEQLASNYWILEYLWKVPFEFWRGVMSLTPLLVWVAALLLLEQRIVMVFLLVTMAGMLQGAPASVLGSRPFDYGLKWQSCSCRANGSRIPTGERVWDRGNVTLLCDCPNGPWVWVPAFCQAVGWGDPITHWSHGQNQWPLSCPQYVYGSVSVTCVWGSVSWFASTGGRDSKIDVWSLVPVGSASCTIAALGSSDRDTVVELSEWGVPCVTCILDRRPASCGTCVRDCWPETGSVRFPFHRCGTGPRLTKDLEAVPFVNRTTPFTIRGPLGNQGRGNPVRSPLGFGSYTMTKIRDSLHLVKCPTPAIEPPTGTFGFFPGVPPINNCMPLGTEVSEALGGAGLTGGFYEPLVRRCSELMGRRNPVCPGYAWLSSGRPDGFIHVQGHLQEVDAGNFIPPPRWLLLDFVFVLLYLMKLAEARLVPLILLLLWWWVNQLAVLGLPAVDAAVAGEVFAGPALSWCLGLPTVSMILGLANLVLYFRWMGPQRLMFLVLWKLARGLDLNSPHQ

SEQ ID NO: 603 - protein, 539 aa, unidentified
  REGION 1..539: note = Mumps Virus F
MKVFLVTCLGFAVFSSSVCVNINILQQIGYIKQQVRQLSYYSQSSSSYIVVKLLPNIQPTDNSCEFKSVTQYNKTLSNLLLPIAENINNIASPSSGSRRHKRFAGIAIGIAALGVATAAQVTAAVSLVQAQTNARAIAAMKNSIQATNRAVFEVKEGTQRLAIAVQAIQDHINTIMNTQLNNMSCQILDNQLATSLGLYLTELTTVFQPQLINPALSPISIQALRSLLGSMTPAVVQATLSTSISAAEILSAGLMEGQIVSVLLDEMQMIVKINIPTIVTQSNALVIDFYSISSFINNQESIIQLPDRILEIGNEQWSYPAKNCKLTRHHIFCQYNEAERLSLESKLCLAGNISACVFSPIAGSYMRRFVALDGTIVANCRSLTCLCKSPSYPIYQPDHHAVTTIDLTACQTLSLDGLDFSIVSLSNITYAENLTISLSQTINTQPIDISTELSKVNASLQNAVKYIKESNHQLQSVNVNSKIGAIIVAALVLSILSIIISLLFCCWAYVATKEIRRINFKTNHINTISSSVDDLIRYL

SEQ ID NO: 604 - protein, 583 aa, unidentified
  REGION 1..583: note = Mumps Virus HN
MEPSKLFTMSDNATFAPGPVINAADKKTFRTCFRILVLSVQAVTLILVIVTLGELVRMINDQGLSNQLSSIADKIRESATMIASAVGVMNQVIHGVTVSLPLQIEGNQNQLLSTLATICTGKKQVSNCSTNIPLVNDLRFINGINKFIIEDYATHDFSIGHPLNMPSFIPTATSPNGCTRIPSFSLGKTHWCYTHNVINANCKDHTSSNQYISMGILVQTASGYPMFKTLKIQYLSDGLNRKSCSIATVPDGCAMYCYVSTQLETDDYAGSSPPTQKLTLLFYNDTVTERTISPTGLEGNWATLVPGVGSGIYFENKLIFPAYGGVLPNSSLGVKSAREFFRPVNPYNPCSGPQQDLDQRALRSYFPSYFSNRRVQSAFLVCAWNQILVTNCELVVPSNNQTLMGAEGRVLLINNRLLYYQRSTSWWPYELLYEISFTFTNSGQSSVNMSWIPIYSFTRPGSGNCSGENVCPTACVSGVYLDPWPLTPYSHQSGINRNFYFTGALLNSSTTRVNPTLYVSALNNLKVLAPYGNQGLFASYTTTTCFQDTGDASVYCVYIMELASNIVGEFQILPVLTRLTITL

SEQ ID NO: 605 - protein, 566 aa, unidentified
  REGION 1..566: note = Sendai Virus F
MTAYIQRSQCISTSLLVVLTTLVSCQIPRDRLSNIGVIVDEGKSLKIAGSHESRYIVLSLVPGVDFENGCGTAQVIQYKSLLNRLLIPLRDALDLQEALITVTNDTTQNAGAPQSRFFGAVIGTIALGVATSAQITAGIALAEAREAKRDIALIKESMTKTHKSIELLQNAVGEQILALKTLQDFVNDEIKPAISELGCETAALRLGIKLTQHYSELLTAFGSNFGTIGEKSLTLQALSSLYSANITEIMTTIKTGQSNIYDVIYTEQIKGTVIDVDLERYMVTLSVKIPILSEVPGVLIHKASSISYNIDGEEWYVTVPSHILSRASFLGGADITDCVESRLTYICPRDPAQLIPDSQQKCILGDTTRCPVTKVVDSLIPKFAFVNGGVVANCIASTCTCGTGRRPISQDRSKGVVFLTHDNCGLIGVNGVELYANRRGHDATWGVQNLTVGPAIAIRPIDISLNLADATNFLQDSKAELEKARKILSEVGRWYNSRETVITIIVVMVVILVVIIVIIIVLYRLRRSMLMGNPDDRIPRDTYTLEPKIRHMYTNGGFDAMAEKRL

SEQ ID NO: 606 - protein, 576 aa, unidentified
  REGION 1..576: note = Sendai Virus HN
MDGDRGKRDSYWSTSPSGSTTKPASGWERSSKADTWLLILSFTQWALSIATVIICIIISARQGYSMKEYSMTVEALNMSSREVKESLTSLIRQEVIARAVNIQSSVQTGIPVLLNKNSRDVIQMIDKSCSRQELTQHCESTIAVHHADGIAPLEPHSFWRCPVGEPYLSSDPEISLLPGPSLLSGSTTISGCVRLPSLSIGEAIYAYSSNLITQGCADIGKSYQVLQLGYISLNSDMFPDLNPVVSHTYDINDNRKSCSVVATGTRGYQLCSMPTVDERTDYSSDGIEDLVLDVLDLKGRTKSHRYRNSEVDLDHPFSALYPSVGNGIATEGSLIFLGYGGLTTPLQGDTKCRTQGCQQVSQDTCNEALKITWLGGKQVVSVIIQVNDYLSERPKIRVTTIPITQNYLGAEGRLLKLGDRVYIYTRSSGWHSQLQIGVLDVSHPLTINWTPHEALSRPGNKECNWYNKCPKECISGVYTDAYPLSPDAANVATVTLYANTSRVNPTIMYSNTTNIINMLRIKDVQLEAAYTTTSCITHFGKGYCFHIIEINQKSLNTLQPMLFKTSIPKLCKAESL

SEQ ID NO: 607 - protein, 530 aa, Autographa californica nucleopolyhedrovirus
MLLVNQSHQGFNKEHTSKMVSAIVLYVLLAAAAHSAFAAEHCNAQMKTGPYKIKNLDITPPKETLQKDVEITIVETDYNENVIIGYKGYYQAYAYNGGSLDPNTRVEETMKTLNVGKEDLLMWSIRQQCEVGEELIDRWGSDSDDCFRDNEGRGQWVKGKELVKRQNNNHFAHHTCNKSWRCGISTSKMYSRLECQDDTDECQVYILDAEGNPINVTVDTVLHRDGVSMILKQKSTFTTRQIKAACLLIKDDKNNPESVTREHCLIDNDIYDLSKNTWNCKFNRCIKRKVEHRVKKRPPTWRHNVRAKYTEGDTATKGDLMHIQEELMYENDLLKMNIELMHAHINKLNNMLHDLIVSVAKVDERLIGNLMNNSVSSTFLSDDTFLLMPCTNPPAHTSNCYNNSIYKEGRWVANTDSSQCIDFSNYKELAIDDDVEFWIPTIGNTTYHDSWKDASGWSFIAQQKSNLITTMENTKFGGVGTSLSDITSMAEGELAAKLTSFMFGHVVNFVIILIVILFLYCMIRNRNRQY

SEQ ID NO: 608 - protein, 985 aa, Ross River Virus
MSAALMMCILANTSFPCSSPPCYPCCYEKQPEQTLRMLEDNVNRPGYYELLEASMTCRNRSRHRRSVTEHFNVYKATRPYLAYCADCGDGYFCYSPVAIEKIRDEAPDGMLKIQVSAQIGLDKAGTHAHTKIRYMAGHDVQESKRDSLRVYTSAACSIHGTMGHFIVAHCPPGDYLKVSFEDADSHVKACKVQYKHDPLPVGREKFVVRPHFGVELPCTSYQLTTAPTDEEIDMHTPPDIPDRTLLSQTAGNVKITAGGRTIRYNCTCGRDNVGTTSTDKTINTCKIDQCHAAVTSHDKWQFTSPFVPRADQTARRGKVHVPFPLTNVTCRVPLARAPDVTYGKKEVTLRLHPDHPTLFSYRSLGAEPHPYEEWVDKFSERIIPVTEEGIEYQWGNNPPVRLWAQLTTEGKPHGWPHEIIQYYYGLYPAATIAAVSGASLMALLTLAATCCMLATARRKCLTPYALTPGAVVPLTLGLLCCAPRANAASFAETMAYLWDENKTLFWMEFAAPAAALALLACCIKSLICCCKPFSFLVLLSLGASAKAYEHTATIPNVVGFPYKAHIERNGFSPMTLQLEVVETSWEPTLNLEYITCEYKTVVPSPFIKCCGTSECSSKEQPDYQCKVYTGVYPFMWGGAYCFCDSENTQLSEAYVDRSDVCKHDHASAYKAHTASLKATIRISYGTINQTTEAFVNGEHAVNVGGSKFIFGPISTAWSPFDNKIVVYKDDVYNQDFPPYGSGQPGRFGDIQSRTVESKDLYANTALKLSRPSPGVVHVPYTPTPSGFKYWLKEKGSSLNTKAPFGCKIKTNPVRAMDCAVGSIPVSMDIPDSAFTRVVDAPAVTDLSCQVVVCTHSSDFGGVATLSYKTDKPGKCAVHSHSNVATLQEATVDVKEDGKVTVHFSTASASPAFKVSVCDAKTTCTAACEPPKDHIVPYGASHNNQVFPDMSGTAMTWVQRLASGLGGLALIAVVVLVLVTCITMRR

SEQ ID NO: 609 - protein, 524 aa, synthetic construct
  REGION 1..524: note = Codon optimized rabies virus
MVPQALLFVPLLVFPLCFGKFPIYTIPDKLGPWSPIDIHHLSCPNNLVVEDEGCTNLSGFSYMELKVGYILAIKVNGFTCTGVVTEAETYTNFVGYVTTTFKRKHFRPTPDACRAAYNWKMAGDPRYEESLHNPYPDYRWLRTVKTTKESLVIISPSVADLDPYDRSLHSRVFPSGKCSGVAVSSTYCSTNHDYTIWMPENPRLGMSCDIFTSSRGKRASKGSETCGFVDERGLYKSLKGACKLKLCGVLGLRLMDGTWVSMQTSNETKWCPPDKLVNLHDFRSDEIEHLVVEELVRKREECLDALESIMTTKSVSFRRLSHLRKLVPGFGKAYTIFNKTLMEADAHYKSVETWNEILPSKGCLRVGGRCHPHVNGVFFNGIILGPDGNVLIPEMQSSLLQQHMELLESSVIPLVHPLADPSTVFKDGDEAEDFVEVHLPDVHNQVSGVDLGLPNWGKYVLLSAGALTALMLIIFLMTCCRRVNRSEPTQHNLRGTGREVSVTPQSGKIISSWESHKSGGETRL

SEQ ID NO: 610 - protein, 524 aa, unidentified
  REGION 1..524: note = Rabies virus (strain Nishigahara RCEH)
MVPQALLLVPILGFSSCFGKFPIYTIPDTLGPWSPIDIHHLSCPNNLVVEDEGCTNLSGFSYMELKVGYISAIKVNGFTCTGVVTEAETYTNFVGYVTTTFKRKHFRPTPDACRAAYNWKMAGDPRYEESLHSPYPDYHWLRTVKTTKESLVIISPSVADLDPYDNSLHSRVFPSGKCSGITVSSVYCSTNHDYTVWMPESLRLGTSCDIFTNSRGKRASKGSKTCGFVDERGLYKSLKGACKLKLCGVLGLRLMDGTWVAMQTSNETKWCPPDQLVNLHDLRSDEIEHLVIEELVKKREECLDALESIITTKSVSFRRLSYLRKLVPGFGKAYTIFNKTLMEAEAHYKSVRTWNEIIPSKGCLRVGGRCHPHVNGVFFNGIILGPDGHVLIPEMQSSLLQQHIELLESSVIPLMHPLADPFTVFKDGDETEDFIEVHLPDVHEQVSGVDLGLPNWGEYVLLSAGTLIALMLIIFLMTCCRKVDRPESTQRSLRGTGRNVSVTSQSGKFIPSWESYKSGGETGL

SEQ ID NO: 611 - protein, 524 aa, unidentified
  REGION 1..524: note = Rabies virus (strain India)
MVPQVLLFVPLLVFSMCFGKFPIYTIPDKLGPWSPIDIHHLSCPNNLVVEDEGCTNLSGFSYMELKVGYISAIKVNGFTCTGVVTEAETYTNFVGYVTTTFKRKHFRPTPDACRAAYNWKMAGDPRYEESLHNPYPDYHWLRTVKTTKESLVIISPSVADLDPYDKSLHSRVFPSGKCSGITISSTYCSTNHDYTIWMPENPRLGTSCDIFTNSRGKRASKGGKTCGFVDERGLYKSLKGACKLKLCGVLGLRLMDGTWVAMQTSDETKWCPPDQLVNLHDFRSDEIEHLVVEELVKKREECLDALESIMATKSVSFRRLSHLRKLVPGFGKAYTIFNKTLMEADAHYKSVRTWNEIIPSKGCLRVGGRCHPHVNGVFFNGIILGPDGHVLIPEMQSSLLQQHMELLESSVIPLMHPLADPSTVFKDGDEAEDFVEVHLPDVHKQISGVDLGLPSWGKYVLVSAGVLVVLMLTIFIMTCCGRVHRPKSTQHGLGGTGRKVSVTSQSGKVISSWESYKSGGETRL

SEQ ID NO: 612 - protein, 524 aa, unidentified
  REGION 1..524: note = Rabies virus (strain CVS-11)
MVPQVLLFVPLLGFSLCFGKFPIYTIPDKLGPWSPIDIHHLSCPNNLVVEDEGCTNLSEFSYMELKVGYISAIKVNGFTCTGVVTEAETYTNFVGYVTTTFKRKHFRPTPDACRAAYNWKMAGDPRYEESLHNPYPDYHWLRTVRTTKESLIIISPSVTDLDPYDKSLHSRVFPGGKCSGITVSSTYCSTNHDYTIWMPENPRPRTPCDIFTNSRGKRASKGNKTCGFVDERGLYKSLKGACRLKLCGVLGLRLMDGTWVAMQTSDETKWCPPDQLVNLHDFRSDEIEHLVVEELVKKREECLDALESIMTTKSVSFRRLSHLRKLVPGFGKAYTIFNKTLMEADAHYKSVRTWNEIIPSKGCLKVGGRCHPHVNGVFFNGIILGPDGHVLIPEMQSSLLQQHMELLKSSVIPLMHPLADPSTVFKEGDEAEDFVEVHLPDVYKQISGVDLGLPNWGKYVLMTAGAMIGLVLIFSLMTWCRRANRPESKQRSFGGTGRNVSVTSQSGKVIPSWESYKSGGEIRL

SEQ ID NO: 613 - protein, 524 aa, unidentified
  REGION 1..524: note = Rabies virus (strain ERA)
MVPQALLFVPLLVFPLCFGKFPIYTILDKLGPWSPIDIHHLSCPNNLVVEDEGCTNLSGFSYMELKVGYILAIKMNGFTCTGVVTEAETYTNFVGYVTTTFKRKHFRPTPDACRAAYNWKMAGDPRYEESLHNPYPDYRWLRTVKTTKESLVIISPSVADLDPYDRSLHSRVFPSGKCSGVAVSSTYCSTNHDYTIWMPENPRLGMSCDIFTNSRGKRASKGSETCGFVDERGLYKSLKGACKLKLCGVLGLRLMDGTWVAMQTSNETKWCPPDQLVNLHDFRSDEIEHLVVEELVRKREECLDALESIMTTKSVSFRRLSHLRKLVPGFGKAYTIFNKTLMEADAHYKSVRTWNEILPSKGCLRVGGRCHPHVNGVFFNGIILGPDGNVLIPEMQSSLLQQHMELLESSVIPLVHPLADPSTVFKDGDEAEDFVEVHLPDVHNQVSGVDLGLPNWGKYVLLSAGALTALMLIIFLMTCCRRVNRSEPTQHNLRGTGREVSVTPQSGKIISSWESHKSGGETRL

SEQ ID NO: 614 - protein, 524 aa, unidentified; identical to SEQ ID NO: 593
  REGION 1..524: note = Rabies virus (strain SAD B19)

SEQ ID NO: 615 - protein, 524 aa, unidentified
  REGION 1..524: note = Rabies virus (strain Vnukovo-32)
MVPQALLFVPLLVFPLCFGKFPIYTIPDKLGPWSPIDIHHLSCPNNLVVEDEGCTNLSGFSYMELKVGYILAIKMNGFTCTGVVTEAENYTNFVGYVTTTFKRKHLRPTPDACRAAYNWKMAGDPRYEESLHNPYPDYSWLRTVKTTKESLVIISPSVADLDPYDRSLHSRVFPSGKCSGVAVSSTYCSTNHDYTIWMPENPRLGKSCDIFTNSRGKRASKGSETCGFVDERGLYKSLKGACKLKLCGVLGLRLMDGTWVAMQTSNETKWCPPDQLVNLHDFRSDEIEHLVVEELVRKREECLDALESIMTTKSVSFRRLSHLRKLVPGFGKAYTIFNKTLMEADAHYKSVRTWNEILPSKGCLRVGGRCHPHVNGVFFNGIILGPDGNVLIPEMQSSLLQQHMELLESSVIPLVHPLADPSTVFKDGDEAEDFVEVHLPDVHNQVSGVDLGLPNWGKYVLLSAGALTALMLIIFLMTCCRRVNRSEPTQHNLRGTGREVSVTPQTWKIISSWESHKSGGETRL

SEQ ID NO: 616 - protein, 524 aa, unidentified
  REGION 1..524: note = Rabies virus (strain Pasteur vaccins / PV)
MVPQALLFVPLLVFPLCFGKFPIYTIPDKLGPWSPIDIHHLSCPNNLVVEDEGCTNLSGFSYMELKVGYISAIKMNGFTCTGVVTEAETYTNFVGYVTTTFKRKHFRPTPDACRAAYNWKMAGDPRYEESLHNPYPDYHWLRTVKTTKESLVIISPSVADLDPYDRSLHSRVFPGGNCSGVAVSSTYCSTNHDYTIWMPENPRLGMSCDIFTNSRGKRASKGSETCGFVDERGLYKSLKGACKLKLCGVLGLRLMDGTWVAMQTSNETKWCPPGQLVNLHDFRSDEIEHLVVEELVKKREECLDALESIMTTKSVSFRRLSHLRKLVPGFGKAYTIFNKTLMEADAHYKSVRTWNEIIPSKGCLRVGGRCHPHVNGVFFNGIILGPDGNVLIPEMQSSLLQQHMELLVSSVIPLMHPLADPSTVFKNGDEAEDFVEVHLPDVHERISGVDLGLPNWGKYVLLSAGALTALMLIIFLMTCWRRVNRSEPTQHNLRGTGREVSVTPQSGKIISSWESYKSGGETGL

SEQ ID NO: 617 - protein, 524 aa, unidentified
  REGION 1..524: note = Rabies virus (strain PM1503/AVO1)
MVPQVLLFVPLLGFSLCFGKFPIYTIPDELGPWSPIDIHHLSCPNNLVVEDEGCTNLSEFSYMELKVGYISAIKVNGFTCTGVVTEAETYTNFVGYVTTTFKRKHFRPTPDACRAAYNWKMAGDPRYEESLHNPYPDYHWLRTVRTTKESLIIISPSVTDLDPYDKSLHSRGFPGGKCSGITVSSTYCSTNHDYTIWMPENPGPRTPCDIFTNSRGKRASKGNKTCGFVDERGLYKSLKGACRLKLCGVLGLRLMDGTWVAMQTSDETKWCPPDQLVNLHDFRSDEIEHLVVEELVKKREECLDALESIMTTKSVSFRRLSHLRKLVPGFGKAYTIFNKTLMEADAHYKSVRTWNEIIPSKGCLKVGGRCHPHVNGVFFNGIILGPDGHVLIPEMQSSLLQQHMELLKSSVIPLMHPLADPSTVFKEGDEAEDFVEVHLPDVYKQISGVDLGLPNWGKYVLMTAGAMIGLVLIFSLMTWCRRANRPESKQRSFGGTGRNVSVTSQSGKVIPSWESYRSGGEIRL

SEQ ID NO: 618 - protein, 524 aa, unidentified
  REGION 1..524: note = Rabies virus (strain China/DRV)
MVPQALLLVPLLGFSLCFGKFPIYTIPTKLGPWSPIDIHHLSCPNNLVVEDEGCTNLSGFSYMELKVGRISAIKVNGFTCTGVVTEAETYTNFVGYVTTTFKRKHFRPMPGCMYSRVQLEDGRSPQIEESLHNPYPDYHWLRTVRTTKESLIIISPSVTDLDPYDKSLHSRVFPGRKCSGITVSSTYCSTNHDYTVWMPEILRLGTSCDIFTNSRGKRASKGSKTCGFVDERGLYKSLKGACKLKLCGVPGLRLMDGTWVAMQTSNETKWCPPGQLVNLHDLHSDEIEHLVVEELVKKREECLDALESITTTKSVSFRRLSHLRKLVPGFGKAYTIFNKTLMEAEAHYKSVRTWNEIIPSKGCLRVGGGCHPHVNGVFFNGIILGPDGHVLIPEMQSSLLQQHIELLESSVIPLMHPLADPFTVFKDGDEIEDFVEVHLPDVHEQVSGVDLGLPNWGEYVLLSAGTLIALMLIIFLITCCKRVDRPESTQRSLRGTGRNVSVTSQSGKFIPSRESYKSGGETGL

SEQ ID NO: 619 - protein, 524 aa, unidentified
  REGION 1..524: note = Rabies virus (strain China/MRV)
MVPQVLLFVLLLGFSLCFGKFPIYTIPDELGPWSPIDIHHLSCPNNLVVEDEGCTNLSEFSYMELKVGYISAIKVNGFTCTGVVTEAETYTNFVGYVTTTFKRKHFRPTPDACRAAYNWKMAGDPRYEESLHNPYPDYHWLRTVRTTKESLIIISPSVTDLDPYDKSLHSRVFPGRKCSGITVSSTYCSTNHDYTIWMPENPRPRTPCDIFTNSRGKRASNGNKTCGFVDERGLYKSLKGACRLKLCGVLGLRLMDGTWVAMQTSGETKWCPPDQLVNLHDFRSDEIEHLVVEELVKKREECLDALESIMTTKSVSFRRLSHLRKLVPGFGKAYTIFNKTLMEADAHYKSVRTWNEIIPSKGCLKVGGRCHPHVNGVFFNGLILGPDDHVLIPEMQSSLLQQHMELLESSVIPLMHPLADPSTVFKEGDEAEDFVEVHLPDVYKQISGVDLGLPNWGKYVLMTAGAMIGLVLIFSLMTWCRRANRPESKQRSFGGTGGNVSVTSQSGKVIPSWESYKSGGEIRL

SEQ ID NO: 620 - protein, 524 aa, unidentified
  REGION 1..524: note = Rabies virus (isolate Human/Algeria/1991)
MVPQALLFVPLLVFPLCFGKFPIYTIPDKLGPWSPIDIHHLRCPNNLVVEDEGCTNLSGFSYMELKVGYISAIKVNGFTCTGVVTEAETYTNFVGYVTTTFKRKHFRPTPDACRAAYNWKMAGDPRYEESLHNPYPDYHWLRTVKTTKESLVIISPSVADLDPYDKSLHSRVFPSGNCSGITVSSTYCSTNHDYTIWMPENPRLETSCDIFTNSRGKRASKGSKTCGFVDERGLYKSLKGACKLKLCGVLGLRLMDGTWVAMQTSDETKWCPPDQLVNLHDFRSDEIEHLVVEELVKKREECLDALESIMTTKSVSLRRLSHLRKLVPGFGKAYTIFNKTLMEAEAHYKSVQTWNEIIPSKGCLRVGGRCHPHVNGVFFNGIILGPDGHVLIPEMQSSLLQQHMELLESSVIPLMHPLADPSTVFKDGDEAEDFVEVHLPDVHKQVSGVDLGLPNWGKYVLLSAGTLIALMLIIFLMTCCRRVNRPKSTERSLGETGRKVSVTSQSGKVISSWESYKSGGETRR

SEQ ID NO: 621 - protein, 524 aa, unidentified
  REGION 1..524: note = Rabies virus (strain HEP-Flury)
MVPQVLLFAPLLVFPLCFGKFPIYTIPDKLGPWSPIDLHHLSCPNNLVVEDEGCTNLSGFSYMELKVGYISAIKVNGFTCTGVVTEAETYTNFVGYVTTTFKRKHFRPTPDACRAAYNWKMAGDPRYEESLHNPYPDYHWLRTVKTTKESLVIISPSVTDLDPYDKSLHSRVFPGGNCSGITVSSTYCSTNHDYTIWMPENLRLGTSCDIFTHSRGKRASKGDKTCGFVDERGLYKSLKGACKLKLCGVLGLRLMDGTWVAMQTSDETKWCPPGQLVNLHDFRSDEIEHLVEEELVKKREECLDALESIMTTKSVSFRRLSHLRKLVPGFGKAYTIFNKTLMEADAHYKSVQTWNEIIPSKGCLRVGERCHPHVNGVFFNGIILGSDGHVLIPEMQSSLLQQHMELLESSVIPLMHPLADPSTVFKDGDEVEDFVEVHLPDVHKQVSGVDLGLPKWGKYVLMIAGALIALMLIIFLMTCCRRVNRPESTQSNLGGTGRNVSVPSQSGKVISSWESYKSGGETRL

SEQ ID NO: 622 - protein, 524 aa, Rabies virus
MIPQALLFVPLLIPSLCLGKFPIYTIPDKLGPWSPIDIHHLSCPNNLVVEDEGCTSLSGFSYMELKVGYISAMKVNGFTCTGVVTEAETYTNFVGYVTTTFKRKHFRPMPDACRAAHDWKIAGDPRYEDSLQNPYPDYHWLRTVKTTKESLVIISPSVADLDPYDKSLHSRVFPSGKCLGITVSSTYCPTNHDYTIWMPVEARLGTSCDIFTNSRGKKASKGGRTCGFVDERGLYKSLKGACKLKLCGVPGLRLMNGTWVSIQTSDDIKWCPPDQLVNLHDFHSDEIEHLVVEELIKKREGCLDALESIMTTKSVSFRRLSHLRKLVPGFGKAYTIFNNTLMEADAHYKSVRTWNEVIPSKGCLKVGGRCHPPVNGVFFNGIILGPDGNVLIPEMQSSLLQQHMELLESSVIPLMHPLADPSTVFKDGDEAEDFVEVHLPDVHKQVSDVDLGLPSWGKYLLMSAGALATLILAIFLITCCRRANRTKSTQRGHRESGGKVSVAPQNGKIISSWELYKSESETGM

SEQ ID NO: 623 - protein, 904 aa, unidentified
  REGION 1..904: note = Herpes simplex virus 2 gB
MRGGGLICALVVGALVAAVASAAPAAPAAPRASGGVAATVAANGGPASRPPPVPSPATTKARKRKTKKPPKRPEATPPPDANATVAAGHATLRAHLREIKVENADAQFYVCPPPTGATVVQFEQPRRCPTRPEGQNYTEGIAVVFKENIAPYKFKATMYYKDVTVSQVWFGHRYSQFMGIFEDRAPVPFEEVIDKINAKGVCRSTAKYVRNNMETTAFHRDDHETDMELKPAKVATRTSRGWHTTDLKYNPSRVEAFHRYGTTVNCIVEEVDARSVYPYDEFVLATGDFVYMSPFYGYREGSHTEHTSYAADRFKQVDGFYARDLTTKARATSPTTRNLLTTPKFTVAWDWVPKRPAVCTMTKWQEVDEMLRAEYGGSFRFSSDAISTTFTTNLTQYSLSRVDLGDCIGRDAREAIDRMFARKYNATHIKVGQPQYYLATGGFLIAYQPLLSNTLAELYVREYMREQDRKPRNATPAPLREAPSANASVERIKTTSSIEFARLQFTYNHIQRHVNDMLGRIAVAWCELQNHELTLWNEARKLNPNAIASATVGRRVSARMLGDVMAVSTCVPVAPDNVIVQNSMRVSSRPGTCYSRPLVSFRYEDQGPLIEGQLGENNELRLTRDALEPCTVGHRRYFIFGGGYVYFEEYAYSHQLSRADVTTVSTFIDLNITMLEDHEFVPLEVYTRHEIKDSGLLDYTEVQRRNQLHDLRFADIDTVIRADANAAMFAGLCAFFEGMGDLGRAVGKVVMGVVGGVVSAVSGVSSFMSNPFGALAVGLLVLAGLVAAFFAFRYVLQLQRNPMKALYPLTTKELKTSDPGGVGGEGEEGAEGGGFDEAKLAEAREMIRYMALVSAMERTEHKARKKGTSALLSSKVTNMVLRKRNKARYSPLHNEDEAGDEDEL

SEQ ID NO: 624 - protein, 393 aa, unidentified
  REGION 1..393: note = Herpes simplex virus 2 gD
MGRLTSGVGTAALLVVAVGLRVVCAKYALADPSLKMADPNRFRGKNLPVLDQLTDPPGVKRVYHIQPSLEDPFQPPSIPITVYYAVLERACRSVLLHAPSEAPQIVRGASDEARKHTYNLTIAWYRMGDNCAIPITVMEYTECPYNKSLGVCPIRTQPRWSYYDSFSAVSEDNLGFLMHAPAFETAGTYLRLVKINDWTEITQFILEHRARASCKYALPLRIPPAACLTSKAYQQGVTVDSIGMLPRFTPENQRTVALYSLKIAGWHGPKPPYTSTLLPPELSDTTNATQPELVPEDPEDSALLEDPAGTVSSQIPPNWHIPSIQDVAPHHAPAAPANPGLIIGALAGSTLAALVIGGIAFWVRRRRSVAPKRLRLPHIRDDDAPPSHQPLFY

SEQ ID NO: 625 - protein, 838 aa, unidentified
  REGION 1..838: note = Herpes simplex virus 2 gH
MGPGLWVVMGVLVGVAGGHDTYWTEQIDPWFLHGLGLARTYWRDTNTGRLWLPNTPDASDPQRGRLAPPGELNLTTASVPMLRWYAERFCFVLVTTAEFPRDPGQLLYIPKTYLLGRPRNASLPELPEAGPTSRPPAEVTQLKGLSHNPGASALLRSRAWVTFAAAPDREGLTFPRGDDGATERHPDGRRNAPPPGPPAGTPRHPTTNLSIAHLHNASVTWLAARGLLRTPGRYVYLSPSASTWPVGVWTTGGLAFGCDAALVRARYGKGFMGLVISMRDSPPAEIIVVPADKTLARVGNPTDENAPAVLPGPPAGPRYRVFVLGAPTPADNGSALDALRRVAGYPEESTNYAQYMSRAYAEFLGEDPGSGTDARPSLFWRLAGLLASSGFAFVNAAHAHDAIRLSDLLGFLAHSRVLAGLAARGAAGCAADSVFLNVSVLDPAARLRLEARLGHLVAAILEREQSLVAHALGYQLAFVLDSPAAYGAVAPSAARLIDALYAEFLGGRALTAPMVRRALFYATAVLRAPFLAGAPSAEQRERARRGLLITTALCTSDVAAATHADLRAALARTDHQKNLFWLPDHFSPCAASLRFDLAEGGFILDALAMATRSDIPADVMAQQTRGVASVLTRWAHYNALIRAFVPEATHQCSGPSHNAEPRILVPITHNASYVVTHTPLPRGIGYKLTGVDVRRPLFITYLTATCEGHAREIEPKRLVRTENRRDLGLVGAVFLRYTPAGEVMSVLLVDTDATQQQLAQGPVAGTPNVFSSDVPSVALLLFPNGTVIHLLAFDTLPIATIAPGFLAASALGVVMITAALAGILRVVRTCVPFLWRRE

SEQ ID NO: 626 - protein, 224 aa, unidentified
  REGION 1..224: note = Herpes simplex virus 2 gL
MGFVCLFGLVVMGAWGAWGGSQATEYVLRSVIAKEVGDILRVPCMRTPADDVSWRYEAPSVIDYARIDGIFLRYHCPGLDTFLWDRHAQRAYLVNPFLFAAGFLEDLSHSVFPADTQETTTRRALYKEIRDALGSRKQAVSHAPVRAGCVNFDYSRTRRCVGRRDLRPANTTSTWEPPVSSDDEASSQSKPLATQPPVLALSNAPPRRVSPTRGRRRHTRLRRN

SEQ ID NO: 627 - protein, 868 aa, unidentified
  REGION 1..868: note = Varicella gB
MFVTAVVSVSPSSFYESLQVEPTQSEDITRSAHLGDGDEIREAIHKSQDAETKPTFYVCPPPTGSTIVRLEPTRTCPDYHLGKNFTEGIAVVYKENIAAYKFKATVYYKDVIVSTAWAGSSYTQITNRYADRVPIPVSEITDTIDKFGKCSSKATYVRNNHKVEAFNEDKNPQDMPLIASKYNSVGSKAWHTTNDTYMVAGTPGTYRTGTSVNCIIEEVEARSIFPYDSFGLSTGDIIYMSPFFGLRDGAYREHSNYAMDRFHQFEGYRQRDLDTRALLEPAARNFLVTPHLTVGWNWKPKRTEVCSLVKWREVEDVVRDEYAHNFRFTMKTLSTTFISETNEFNLNQIHLSQCVKEEARAIINRIYTTRYNSSHVRTGDIQTYLARGGFVVVFQPLLSNSLARLYLQELVRENTNHSPQKHPTRNTRSRRSVPVELRANRTITTTSSVEFAMLQFTYDHIQEHVNEMLARISSSWCQLQNRERALWSGLFPINPSALASTILDQRVKARILGDVISVSNCPELGSDTRIILQNSMRVSGSTTRCYSRPLISIVSLNGSGTVEGQLGTDNELIMSRDLLEPCVANHKRYFLFGHHYVYYEDYRYVREIAVHDVGMISTYVDLNLTLLKDREFMPLQVYTRDELRDTGLLDYSEIQRRNQMHSLRFYDIDKVVQYDSGTAIMQGMAQFFQGLGTAGQAVGHVVLGATGALLSTVHGFTTFLSNPFGALAVGLLVLAGLVAAFFAYRYVLKLKTSPMKALYPLTTKGLKQLPEGMDPFAEKPNATDTPIEEIGDSQNTEPSVNSGFDPDKFREAQEMIKYMTLVSAAERQESKARKKNKTSALLTSRLTGLALRNRRGYSRVRTENVTGV

SEQ ID NO: 628 - protein, 340 aa, unidentified
  REGION 1..340: note = Varicella gK
MQALGIKTEHFIIMCLLSGHAVFTLWYTARVKFEHECVYATTVINGGPVVWGSYNNSLIYVTFVNHSTFLDGLSGYDYSCRENLLSGDTMVKTAISTPLHDKIRIVLGTRNCHAYFWCVQLKMIFFAWFVYGMYLQFRRIRRMFGPFRSSCELISPTSYSLNYVTRVISNILLGYPYTKLARLLCDVSMRRDGMSKVFNADPISFLYMHKGVTLLMLLEVIAHISSGCIVLLTLGVAYTPCALLYPTYIRILAWVVVCTLAIVELISYVRPKPTKDNHLNHINTGGIRGICTTCCATVMSGLAIKCFYIVIFAIAVVIFMHYEQRVQVSLFGESENSQKH

SEQ ID NO: 629 - protein, 841 aa, unidentified
  REGION 1..841: note = Varicella gH
MFALVLAVVILPLWTTANKSYVTPTPATRSIGHMSALLREYSDRNMSLKLEAFYPTGFDEELIKSLHWGNDRKHVFLVIVKVNPTTHEGDVGLVIFPKYLLSPYHFKAEHRAPFPAGRFGFLSHPVTPDVSFFDSSFAPYLTTQHLVAFTTFPPNPLVWHLERAETAATAERPFGVSLLPARPTVPKNTILEHKAHFATWDALARHTFFSAEAIITNSTLRIHVPLFGSVWPIRYWATGSVLLTSDSGRVEVNIGVGFMSSLISLSSGPPIELIVVPHTVKLNAVTSDTTWFQLNPPGPDPGPSYRVYLLGRGLDMNFSKHATVDICAYPEESLDYRYHLSMAHTEALRMTTKADQHDINEESYYHIAARIATSIFALSEMGRTTEYFLLDEIVDVQYQLKFLNYILMRIGAGAHPNTISGTSDLIFADPSQLHDELSLLFGQVKPANVDYFISYDEARDQLKTAYALSRGQDHVNALSLARRVIMSIYKGLLVKQNLNATERQALFFASMILLNFREGLENSSRVLDGRTTLLLMTSMCTAAHATQAALNIQEGLAYLNPSKHMFTIPNVYSPCMGSLRTDLTEEIHVMNLLSAIPTRPGLNEVLHTQLDESEIFDAAFKTMMIFTTWTAKDLHILHTHVPEVFTCQDAAARNGEYVLILPAVQGHSYVITRNKPQRGLVYSLADVDVYNPISVVYLSRDTCVSEHGVIETVALPHPDNLKECLYCGSVFLRYLTTGAIMDIIIIDSKDTERQLAAMGNSTIPPFNPDMHGDDSKAVLLFPNGTVVTLLGFERRQAIRMSGQYLGASLGGAFLAVVGFGIIGWMLCGNSRLREYNKIPLT

SEQ ID NO: 630 - protein, 160 aa, unidentified
  REGION 1..160: note = Varicella gL
MASHKWLLQMIVFLKTITIAYCLHLQDDTPLFFGAKPLSDVSLIITEPCVSSVYEAWDYAAPPVSNLSEALSGIVVKTKCPVPEVILWFKDKQMAYWTNPYVTLKGLTQSVGEEHKSGDIRDALLDALSGVWVDSTPSSTNIPENGCVWGADRLFQRVCQ

SEQ ID NO: 631 - protein, 445 aa, unidentified
  REGION 1..445: note = Hepatitis B gL
MQLIITSKLGIIYILCGRLAFYIREKLHAVPHFVGHHILGNKSYSMGGWSSKPRQGMGTNLSVPNPLGFFPDHQLDPAFGANSNNPDWDFNPNKDHWPEAKQVGAGAFGPGFTPPHGGLLGWSPQAQGTLTTVPAAPPPASTNRQSGRQPTPISPPLRDSHPQAMQWNSTTFHQALLDPRVRGLYFPAGGSSSGTVNPVPTTASPISSIFSRTGDPAPNMESTTSGFLGPLLVLQAGFFLLTRILTIPQSLDSWLTSLNFLGGTPKCPGQNSQSPTSNHSPTSCPPTCPGYRWMCLRRFIIFLFILLLCLIFLLVLLDYKGMLPVCPLLPGTSTTSTGPCKTCTIPAQNTSMFPSCCCTKPSDGNCTCIPIPSSWAFARFLWEWASVRFSWLSLLVPFVQWSAGLSPTVWLSVIWTMWYWGPSLYNILSPFLPLLPILCCLWAYI

SEQ ID NO: 632 - protein, 281 aa, unidentified
  REGION 1..281: note = Hepatitis B gM
MQWNSTTFHQALQDPRVRGLYFPAGGSSSGTVNPVPTTASLISSIFSRIGDPAPNMESITSGFLGPLLVLQAGFFLLTKILTIPQSLDSWWTSLNFLGGAPVCLGQNSQSPTSNHSPTSCPPICPGYRWMCLRRFIIFLFILLLCLIFLLVLLDYQGMLPVCPLIPGSSTTSTGPCRTCMTLAQGTSMFPSCCCSKPSDGNCTCIPIPSSWAFGKFLWEWASARFSWLSLLVPFVQWFAGLSPTVWLSVIWMMWYWGPSLYDILSPFIPLLPIFFCLWVYI

SEQ ID NO: 633 - protein, 226 aa, unidentified
  REGION 1..226: note = Hepatitis B gS
MESITSGFLGPLLVLQAGFFLLTKILTIPQSLDSWWTSLNFLGGAPVCLGQNSQSPTSNHSPTSCPPICPGYRWMCLRRFIIFLFILLLCLIFLLVLLDYQGMLPVCPLIPGSSTTSTGPCRTCMTLAQGTSMFPSCCCSKPSDGNCTCIPIPSSWAFGKFLWEWASARFSWLSLLVPFVQWFAGLSPTVWLSVIWMMWYWGPSLYDILSPFIPLLPIFFCLWVYI

SEQ ID NO: 634 - protein, 982 aa, Eastern equine encephalitis virus
MSLATVMCVLANITFPCDQPPCMPCCYEKNPHETLTMLEQNYDSRAYDQLLDAAVKCNARRTRRDLDTHFTQYKLARPYIADCPNCGHSRCDSPIAIEEVRGDAHAGVIRIQTSAMFGLKTDGVDLAYMSFMNGKTQKSIKIDNLHVRTSAPCSLVSHHGYYILAQCPPGDTVTVGFHDGPNRHTCTVAHKVEFRPVGREKYRHPPEHGVELPCNRYTHKRADQGHYVEMHQPGLVADHSLLSIHSAKVKITVPSGAQVKYYCKCPDVREGITSSDHTTTCTDVKQCRAYLIDNKKWVYNSGRLPRGEGDTFKGKLHVPFVPVKAKCIATLAPEPLVEHKHRTLILHLHPDHPTLLTTRSLGSDANPTRQWIERPTTVNFTVTGEGLEYTWGNHPPKRVWAQESGEGNPHGWPHEVVVYYYNRYPLTTIIGLCTCVAIIMVSCVTSVWLLCRTRNLCITPYKLAPNAQVPILLALLCCIKPTRADDTLQVLNYLWNNNQNFFWMQTLIPLAALIVCMRMLRCLFCCGPAFLLVCGALGAAAYEHTAVMPNKVGIPYKALVERPGYAPVHLQIQLVNTRIIPSTNLEYITCKYKTKVPSPVVKCCGATQCTSKPHPDYQCQVFTGVYPFMWGGAYCFCDTENTQMSEAYVERSEECSIDHAKAYKVHTGTVQAMVNITYGSVSWRSADVYVNGETPAKIGDAKLIIGPLSSAWSPFDNKVVVYGHEVYNYDFPEYSTGKAGSFGDLQSRTSTSNDLYANTNLKLQRPQAGIVHTPFTQAPSGFERWKRDKGAPLNDVAPFGCSIALEPLRAENCAVGSIPISIDIPDAAFTRISETPTVSDLECKITECTYASDFGGIATVAYKSSKAGNCPIHSPSGVAVIKENDVTLAESGSFTFHFSTANIHPAFKLQVCTSAVTCKGDCKPPKDHIVDYPAQHTESFTSAISATAWSWLKVLVGGTSAFIVLGLIATAVVALVLFFHRH

SEQ ID NO: 635 - protein, 981 aa, Venezuelan equine encephalitis virus
MSLVTTMCLLANVTFPCAEPPICYDRKPAETLAMLSVNVDNPGYDELLEAAVKCPGRKRRSTKELFKEYKLTRPYMARCIRCAVGSCHSPIAIEAVKSDGHDGYVRLQTSSQYGLDSSGNLKGRTMRYDMHGTIEEIPLHQVSLHTSRPCHIVDGHGYFLLARCPAGDSITMEFKKGSVTHSCSVPYEVKFNPVGRELYTHPPEHGAEQACQVYAHDAQNRGAYVEMHLPGSEVDSSLISLSGSSVTVTPPVGTSALVECKCGGTKISETINKAKQFSQCTKKEQCRAYRLQNDKWVYNSDKLPKAAGATLKGKLHVPFLLADGKCTVPLAPEPMITFGFRSVSLKLHPKNPTYLTTRQLADEPHYTHELISEPAVRNFTVTEKGWEFVWGNHPPKRFWAQETAPGNPHGLPHEVITHYYHRYPMSTILGLSICAAIVTVSVAASTWLFCKSRVSCLTPYRLTPNARMPLCLAVLCCARTARAETTWESLDHLWNNNQQMFWIQLLIPLAALIVVTRLLKCVCCVVPFLVVAGAAGAGAYEHATTMPSQAGISYNTIVNRAGYAPLPISITPTKIKLIPTVNLEYVTCHYKTGMDSPAIKCCGSQECTPTNRPDEQCKVFTGVYPFMWGGAYCFCDTENTQVSKAYVMKSDDCLADHAEAYKAHTASVQAFLNITVGEHSIVTTVYVNGETPVNFNGVKLTAGPLSTAWTPFDRKIVQYAGEIYNYDFPEYGAGQPGAFGDIQSRTVSSSDLYANTNLVLQRPKAGAIHVPYTQAPSGFEQWKKDKAPSLKFTAPFGCEIYTNPIRAENCAVGSIPLAFDIPDALFTRVSETPTLSAAECTLNECVYSSDFGGIATVKYSASKSGKCAVHVPSGTATLKEAAVELTEQGSATIHFSTANIHPEFRLQICTSYVTCKGDCHPPKDHIVTHPQYHAQTFTAAVSKTAWTWLTSLLGGSAVIIIIGLVLATIVAMYVLTNQKHN

SEQ ID NO: 636 - protein, 978 aa, unidentified
  REGION 1..978: note = Western equine encephalitis virus (WEEV)
MSLVTALCVLSNVTFPCDKPPVCYSLAPERTLDVLEENVNNPNYDTLLENVLKCPSRRPKRSITDDFTLTSPYLGFCPYCRHSAPCFSPIKIENVWDESDDGSIRIQVSAQFGYDQAGTADVTKFRYMSYDHDHDIKEDSVKKIAISTSGPCRRLGHKGYFLLAQCPPGDSVTVSITSGASENSCTVEKKIRRKFVGREEYLFPPVHGKLVKCHVYDHLKETSAGYITMHRPGPHAYKSYLEEASGEVYIKPPSGKNVTYECKCGDYSTGIVSTRTKMNGCTKAKQCIAYKSDQTKWVYNSPDLIRHTDHSVQGKLHIPFRLTPTFCPVPLAHTPTVTKWFKGITLHLTATRPTLLTTRKLGLRADATAEWITGTTSRNFSVGREGLEYVWGNHEPVRVWAQESAPGDPHGWPHEIIIHYYHRHPVYTVIVLCGVALAILVGIASSAACIAKARRDCLTPYALAPNATVPTALAVLCCIRPTNAETFGETLNHLWFNNQPFLWAQLCIPLAALIILFRCFSCCMPFLLVAGVCLGKVDAFEHATTVPNVPGIPYKALVERAGYAPLNLEITVVSSELTPSTNKEYVTCKFHTVIPSPQVKCCGSLECKASSKADYTCRVFGGVYPFMWGGAQCFCDSENTQLSEAYVEFAPDCTIDHAVALKVHTAALKVGLRIVYGNTTAHLDTFVNGVTPGSSRDLKVIAGPISAAFSPFDHKVVIRKGLVYNYDFPEYGAMKPGAFGDIQASSLDATDIVARTDIRLLKPSVKNIHVPYTQAVSGYEMWKNNSGRPLQETAPFGCKIEVEPLRASNCAYGHIPISIDIPDAAFVRSSESPTILEVSCTVADCIYSADFGGSLTLQYKADREGHCPVHSHSTTAVLKEATTHVTATGSITLHFSTSSPQANFIVSLCGKKTTCNAECKPPADHIIGEPHKVDQEFQAAVSKTSWNWLLALFGGASSLIAVGLIVLVCSSMLINTRR

SEQ ID NO: 637 - protein, 987 aa, Semliki Forest virus
MSAPLITAMCVLANATFPCFQPPCVPCCYENNAEATLRMLEDNVDRPGYYDLLQAALTCRNGTRHRRSVSQHFNVYKATRPYIAYCADCGAGHSCHSPVAIEAVRSEATDGMLKIQFSAQIGIDKSDNHDYTKIRYADGHAIENAVRSSLKVATSGDCFVHGTMGHFILAKCPPGEFLQVSIQDTRNAVRACRIQYHHDPQPVGREKFTIRPHYGKEIPCTTYQQTTAETVEEIDMHMPPDTPDRTLLSQQSGNVKITVGGKKVKYNCTCGTGNVGTTNSDMTINTCLIEQCHVSVTDHKKWQFNSPFVPRADEPARKGKVHIPFPLDNITCRVPMAREPTVIHGKREVTLHLHPDHPTLFSYRTLGEDPQYHEEWVTAAVERTIPVPVDGMEYHWGNNDPVRLWSQLTTEGKPHGWPHQIVQYYYGLYPAATVSAVVGMSLLALISIFASCYMLVAARSKCLTPYALTPGAAVPWTLGILCCAPRAHAASVAETMAYLWDQNQALFWLEFAAPVACILIITYCLRNVLCCCKSLSFLVLLSLGATARAYEHSTVMPNVVGFPYKAHIERPGYSPLTLQMQVVETSLEPTLNLEYITCEYKTVVPSPYVKCCGASECSTKEKPDYQCKVYTGVYPFMWGGAYCFCDSENTQLSEAYVDRSDVCRHDHASAYKAHTASLKAKVRVMYGNVNQTVDVYVNGDHAVTIGGTQFIFGPLSSAWTPFDNKIVVYKDEVFNQDFPPYGSGQPGRFGDIQSRTVESNDLYANTALKLARPSPGMVHVPYTQTPSGFKYWLKEKGTALNTKAPFGCQIKTNPVRAMNCAVGNIPVSMNLPDSAFTRIVEAPTIIDLTCTVATCTHSSDFGGVLTLTYKTNKNGDCSVHSHSNVATLQEATAKVKTAGKVTLHFSTASASPSFVVSLCSARATCSASCEPPKDHIVPYAASHSNVVFPDMSGTALSWVQKISGGLGAFAIGAILVLVVVTCIGLRR

SEQ ID NO: 638 - protein, 982 aa, Sindbis virus
MSAAPLVTAMCLLGNVSFPCDRPPTCYTREPSRALDILEENVNHEAYDTLLNAILRCGSSGRSKRSVIDDFTLTSPYLGTCSYCHHTVPCFSPVKIEQVWDEADDNTIRIQTSAQFGYDQSGAASANKYRYMSLKQDHTVKEGTMDDIKISTSGPCRRLSYKGYFLLAKCPPGDSVTVSIVSSNSATSCTLARKIKPKFVGREKYDLPPVHGKKIPCTVYDRLKETTAGYITMHRPRPHAYTSYLEESSGKVYAKPPSGKNITYECKCGDYKTGTVSTRTEITGCTAIKQCVAYKSDQTKWVFNSPDLIRHDDHTAQGKLHLPFKLIPSTCMVPVAHAPNVIHGFKHISLQLDTDHLTLLTTRRLGANPEPTTEWIVGKTVRNFTVDRDGLEYIWGNHEPVRVYAQESAPGDPHGWPHEIVQHYYHRHPVYTILAVASATVAMMIGVTVAVLCACKARRECLTPYALAPNAVIPTSLALLCCVRSANAETFTETMSYLWSNSQPFFWVQLCIPLAAFIVLMRCCSCCLPFLVVAGAYLAKVDAYEHATTVPNVPQIPYKALVERAGYAPLNLEITVMSSEVLPSTNQEYITCKFTTVVPSPKIKCCGSLECQPAAHADYTCKVFGGVYPFMWGGAQCFCDSENSQMSEAYVELSADCASDHAQAIKVHTAAMKVGLRIVYGNTTSFLDVYVNGVTPGTSKDLKVIAGPISASFTPFDHKVVIHRGLVYNYDFPEYGAMKPGAFGDIQATSLTSKDLIASTDIRLLKPSAKNVHVPYTQASSGFEMWKNNSGRPLQETAPFGCKIAVNPLRAVDCSYGNIPISIDIPNAAFIRTSDAPLVSTVKCEVSECTYSADFGGMATLQYVSDREGQCPVHSHSSTATLQESTVHVLEKGAVTVHFSTASPQANFIVSLCGKKTTCNAECKPPADHIVSTPHKNDQEFQAAISKTSWSWLFALFGGASSLLIIGLMIFACSMMLTSTRR

SEQ ID NO: 639 - protein, 981 aa, Chikungunya virus
MCLLANTTFPCSQPPCTPCCYEKEPEETLRMLEDNVMRPGYYQLLQASLTCSPHRQRRSTKDNFNVYKATRPYLAHCPDCGEGHSCHSPVALERIRNEATDGTLKIQVSLQIGIKTDDSHDWTKLRYMDNHMPADAERAGLFVRTSAPCTITGTMGHFILARCPKGETLTVGFTDSRKISHSCTHPFHHDPPVIGREKFHSRPQHGKELPCSTYVQSTAATTEEIEVHMPPDTPDRTLMSQQSGNVKITVNGQTVRYKCNCGGSNEGLTTTDKVINNCKVDQCHAAVTNHKKWQYNSPLVPRNAELGDRKGKIHIPFPLANVTCRVPKARNPTVTYGKNQVIMLLYPDHPTLLSYRNMGEEPNYQEEWVMHKKEVVLTVPTEGLEVTWGNNEPYKYWPQLSTNGTAHGHPHEIILYYYELYPTMTVVVVSVATFILLSMVGMAAGMCMCARRRCITPYELTPGATVPFLLSLICCIRTAKAATYQEAAIYLWNEQQPLFWLQALIPLAALIVLCNCLRLLPCCCKTLAFLAVMSVGAHTVSAYEHVTVIPNTVGVPYKTLVNRPGYSPMVLEMELLSVTLEPTLSLDYITCEYKTVIPSPYVKCCGTAECKDKNLPDYSCKVFTGVYPFMWGGAYCFCDAENTQLSEAHVEKSESCKTEFASAYRAHTASASAKLRVLYQGNNITVTAYANGDHAVTVKDAKFIVGPMSSAWTPFDNKIVVYKGDVYNMDYPPFGAGRPGQFGDIQSRTPESKDVYANTQLVLQRPAVGTVHVPYSQAPSGFKYWLKERGASLQHTAPFGCQIATNPVRAVNCAVGNMPISIDIPEAAFTRVVDAPSLTDMSCEVPACTHSSDFGGVAIIKYAASKKGKCAVHSMTNAVTIREAEIEVEGNSQLQISFSTALASAEFRVQVCSTQVHCAAECHPPKDHIVNYPASHTTLGVQDISATAMSWVQKITGGVGLVVAVAALILIVVLCVSFSRH

SEQ ID NO: 640 - protein, 503 aa, unidentified
  REGION 1..503: note = Bornavirus BoDV-1
MQLSMSSLIGFGTLVLALSAQTFDLQGLSCNTDSTPGLIDLEIRRLCHTPTENVISCEVSYLNHTTISLPAVHTSCLKYHCKTYWGFFGSYSADRIINRYTGTVKGCLNNSAPEDPFECNWFYCCSAITTEICRCSITNVTVAVQTFPPFMYCSFADCSTVSQQELESGKAMLSDGSTLTYTPYILQSEVVNKTLNGTILCNSSSKIVSFDEFRRSYSLANGSYQSSSINVTCVNYTSSCRSKLRRRRRDTQQIEYLVHKLRPTLKDAWEDCEILQSLLLGVFGTGIASASQFLRGWLNHPDIIGYIVNGVGVVWQCHRVNVTFMAWNESTYYPPVDYNGRKYFLNDEGRLQTNTPEARPGLKRVMWFGRYFLGTVGSGVKPRRIRYNKTSHDYHLEEFEASLNMTPQTSIASGHETDPINHAYGTQADLLPYTRSSNITSTDTGSGWVHIGLPSFAFLNPLGWLRDLLAWAAWLGGVLYLISLCVSLPASFARRRRLGRWQE

SEQ ID NO: 641 - protein, 496 aa, Tick-borne encephalitis virus
SRCTHLENRDFVTGTQGTTRVTLVLELGGCVTITAEGKPSMDVWLDAIYQENPAQTREYCLHAKLSDTKVAARCPTMGPATLAEEHQGGTVCKRDQSDRGWGNHCGLFGKGSIVACVKAACEAKKKATGHVYDANKIVYTVKVEPHTGDYVAANETHSGRKTASFTVSSEKTILTMGEYGDVSLLCRVASGVDLAQTVILELDKTVEHLPTAWQVHRDWFNDLALPWKHEGARNWNNAERLVEFGAPHAVKMDVYNLGDQTGVLLKALAGVPVAHIEGTKYHLKSGHVTCEVGLEKLKMKGLTYTMCDKTKFTWKRAPTDSGHDTVVMEVTFSGTKPCRIPVRAVAHGSPDVNVAMLITPNPTIENNGGGFIEMQLPPGDNIIYVGELSYQWFQKGSSIGRVFQKTKKGIERLTVIGEHAWDFGSAGGFLSSIGKALHTVLGGAFNSIFGGVGFLPKLLLGVALAWLGLNMRNPTMSMSFLLAGVLVLAMTLGVGA

SEQ ID NO: 642 - protein, 612 aa, unidentified
  REGION 1..612: note = Usutu virus
STVSNCPTTGEAHNPKRAEDTYVCKSGVTDRGWGNGCGLFGKGSIDTCANFTCSLKAMGRMIQPENVKYEVGIFIHGSTSSDTHGNYSSQLGASQAGRFTITPNSPAITVKMGDYGEISVECEPRNGLNTEAYYIMSVGTKHFLVHREWFNDLALPWTSPASSNWRNREILLEFEEPHATKQSVVALGSQEGALHQALAGAVPVSFSGSVKLTSGHLKCRVKMEKLTLKGTTYGMCTEKFSFAKNPADTGHGTVVLELQYTGSDGPCKIPISIVASLSDLTPIGRMVTANPYVASSEANAKVLVEMEPPFGDSYIVVGRGDKQINHHWHKAGSSIGKAFITTIKGAQRLAALGDTAWDFGSVGGIFNSVGKAVHQVFGGAFRTLFGGMSWITQGLMGALLLWMGVNARDRSIALVMLATGGVLLFLATNVHADSGCAIDVGRRELRCGQGIFIHNDVEAWVDRYKFMPETPKQLAKVIEQAHAKGICGLRSVSRLEHVMWENIRDELNTLLRENAVDLSVVVEKPKGMYKSAPQRLALTSEEFEIGWKAWGKSLVFAPELANHTFVVDGPETKECPDAKRAWNSLEIEDFGFGIMSTRVWLKVREHNTTDCD

SEQ ID NO: 643 - protein, 501 aa, St. Louis encephalitis virus
FNCLGTSNRDFVEGASGATWIDLVLEGGSCVTVMAPEKPTLDFKVMKMEATELATVREYCYEATLDTLSTVARCPTTGEAHNTKRSDPTFVCKRDVVDRGWGNGCGLFGKGSIDTCAKFTCKSKATGKTILRENIKYEVAIFVHGSTDSTTHGNYFEQIGKNQAARFTISPQAPSFTANMGEYGTVTIDCEARSGINTEDYYVFTVKEKSWLVNRDWFHDLNLPWTSPATTDWRNRETLVEFEEPHATKQTVVALGSQEGALHTALAGAIPATVSSSTLTLQSGHLKCRAKLDKVKIKGTTYGMCDSAFTFSKNPADTGHGTVIVELQYTGSNGPCRVPISVTANLMDLTPVGRLVTVNPFISTGGANNKVMVEVEPPFGDSYIVVGRGTTQINYHWHKEGSSIGKALATTWKGAQRLAVLGDTAWDFGSIGGVFNSIGKAVHQVFGGAFRTLFGGMSWITQGLLGALLLWMGLQARDRSISLTLLAVGGILIFLATSVQA

SEQ ID NO: 644 - protein, 472 aa, Yellow fever virus
VGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGI

SEQ ID NO: 645 - protein, 495 aa, Dengue virus type 2
MRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQA

SEQ ID NO: 646 - protein, 493 aa, Dengue virustype 3
MRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITSQASTAEAILPEYGTLGLECSPRTGLDFNEMILLTMKNKAWMVHRQWFFDLPLPWTSGATTKTPTWNRKELLVTFKNAHAKKQEVVVLGSQEGAMHTALTGATEIQTSGGTSIFAGHLKCRLKMDKLKLKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYRKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGVVVQA

SEQ ID NO: 647 - protein, 72 aa, Dengue virus type 4
FGSVGGLFTSLGKAVHQVFGSVYTTMFGGVSWMIRILIGFLVLWIGTNSRNTSMAMTCIAVGGITLFLGFTV

SEQ ID NO: 648 - protein, 501 aa, Murray Valley encephalitis virus
FNCLGMSSRDFIEGASGATWVDLVLEGDSCITIMAADKPTLDIRMMNIEATNLALVRNYCYAATVSDVSTVSNCPTTGESHNTKRADHNYLCKRGVTDRGWGNGCGLFGKGSIDTCAKFTCSNSAAGRLILPEDIKYEVGVFVHGSTDSTSHGNYSTQIGANQAVRFTISPNAPAITAKMGDYGEVTVECEPRSGLNTEAYYVMTIGTKHFLVHREWFNDLLLPWTSPASTEWRNREILVEFEEPHATKQSVVALGSQEGALHQALAGAIPVEFSSSTLKLTSGHLKCRVKMEKLKLKGTTYGMCTEKFTFSKNPADTGHGTVVLELQYTGSDGPCKIPISSVASLNDMTPVGRMVTANPYVASSTANAKVLVEIEPPFGDSYIVVGRGDKQINHHWHKEGSSIGKAFSTTLKGAQRLAALGDTAWDFGSVGGVFNSIGKAVHQVFGGAFRTLFGGMSWISPGLLGALLLWMGVNARDKSIALAFLATGGVLLFLATNVHA

SEQ ID NO: 649 - protein, 497 aa, Powassan virus
TRCTHLENRDFVTGTQGTTRVSLVLELGGCVTITAEGKPSIDVWLEDIFQESPAETREYCLHAKLTNTKVEARCPTTGPATLPEEHQANMVCKRDQSDRGWGNHCGFFGKGSIVACAKFECEEAKKAMGHVYDSTKITYVVKVEPHTGDYLAANETNSNRKSAQFTVASEKVILRLGDYGDVSLTCKVASGIDVAQTVVMSLDSSKDHLPSAWQVHRDWFEDLALPWKHKDNQDWNSVEKLVEFGPPHAVKMDVFNLGDQTAVLLKSLAGVPLASVEGQKYHLKSGHVTCDVGLEKLKLKGTTYSMCDKAKFKWKRVPVDSGHDTVVMEVSYTGSDKPCRIPVRAVAHGVPAVNVAMLITPNPTIETNGGGFIEMQLPPGDNIIYVGDLSQQWFQKGSTIGRMFEKTRRGLERLSVVGEHAWDFGSVGGVLSSVGKAIHTVLGGAFNTLFGGVGFIPKMLLGVALVWLGLNARNPTMSMTFLAVGALTLMMTMGVGA

SEQ ID NO: 650 - protein, 564 aa, unidentified
  REGION 1..564: note = H5 Hemagglutinin
MERIVLLLAIVSLVKSDQICIGYHANKSTKQVDTIMEKNVTVTHAQDILERTHNGKLCSLNGVKPLILRDCSVAGWLLGNPMCDEFLNVPEWSYIVEKDNPINSLCYPGDFNDYEELKHLLSSTNHFEKIQIIPRSSWSNHDASSGVSSACPYIGRSSFFRNVVWLIKKDNAYPTIKRSYNNTNQEDLLILWGIHHPNDAAEQTKLYQNPTTYVSVGTSTLNQRSIPEIATRPKVNGQSGRMEFFWTILKPNDAINFESNGNFIAPEYAYKIVKKGDSAIMKSGLAYGNCDTKCQTPVGAINSSMPFHNIHPHTIGECPKYVKSDRLVLATGLRNVPQRKKRGLFGAIAGFIEGGWQGMVDGWYGYHHSNEQGSGYAADKESTQKAIDGITNKVNSIIDKMNTQFKAVGKEFNNLERRVENLNKKMEDGFLDVWTYNVELLVLMENERTLDFHDSNVKNLYDKVRLQLKDNARELGNGCFEFYHKCDNECMESVRNGTYDYPQYSEEARLNREEISGVKLESMGVYQILSIYSTVASSLALAIMIAGLSFWMCSNGSLQCRICI

SEQ ID NO: 651 - protein, 560 aa, unidentified
  REGION 1..560: note = H7 Hemagglutinin
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGISGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 652 - protein, 469 aa, unidentified
  REGION 1..469: note = N1 Neuraminidase
MNPNQKIITIGSICMIVGIISLILQIGNIISIWVSHSIQTGNQNQPEICNQSIITYENNTWVNQTYVNISNTNFVTEQALAPVALAGNSSLCPISGWAIYSKDNGIRIGSKGDVFVIREPFISCSHLECRTFFLTQGALLNDKHSNGTVKDRSPYRTLMSCPIGESPSPYNSRFESVAWSASACHDGIGWLTIGISGPDNGAVAVLKYNGIITDTIKSWRNNILRTQESECACMNGSCFTIMTDGPSNGQASYKIFKIEKGKVVKSVELNAPNYHYEECSCYPDAGEIMCVCRDNWHGSNRPWVSFNQNLEYQIGYICSGVFGDNPRPNDGAGSCGPVSSNGAYGVKGFSFKYGKGVWIGRTKSTSSRSGFEMIWDPNGWTETDSSFSVKQDIVAITDWSGYSGSFVQHPELTGLDCMRPCFWVELIRGRPKENTIWTSGSSISFCGVNSDTVGWSWPDGAELPFTIDK

SEQ ID NO: 653 - protein, 607 aa, Canine Distemper Virus
MLSYQDKVGAFYKDNARANSSKLSLVTEEQGGRRPPYLLFVLLILLVGIMALLAITGVRFHQVSTSNMEFSRLLKEDMEKSEAVHHQVIDVLTPLFKIIGDEVGLRLPQKLNEIKQFILQKTNFFNPNREFDFRDLHWCINPPSKIKVNFTNYCDTIGIRKSIASAANPILLSAHTGGRGDIFPPYRCSGATTSVGRVFPLSVSLSMSLISRTSEIINMLTAISDGVYGKTYLLVPDYIEGEFDTQKIRVFEIGFIKRWLNDMPLLQTTNYMVLPENSKAKVCTIAVGELTLASLCVDESTILLYHDSNGSQDGILVVTLGIFGATPMDQVEEVIPVAHPSVEKIHITNHRGFIKDSIATWMVPALVSEKQEEQKSCLESACQRKSYPMCNQTSWEPFGGGQLPSYGRLTLPLDPSIDLQLNISFTYGPVILNGNGMDYYESPLLGSGWLTIPPKNGTVLGLINKAGRGDQFTVIPHVLTFAPRESSGNCYLPIQTSQIMDKDVLTESNLVVLPTQNFRYVIATYDISRGDHAIVYYVYDPIRTISYTHPFRLTTKGRPDFLRIECFVWDDDLWCHQFYRFETDSTNSTTSVENLVRIRFSCSRSKP

SEQ ID NO: 654 - protein, 511 aa, unidentified
  REGION 1..511: note = Vesicular stomatitis, alagoas serotype
MTPAFILCMLLAGSSWAKFTIVFPQSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 655 - protein, 505 aa, unidentified
  REGION 1..505: note = American bat vesiculovirus (ABVV)
MVRIICWLGLVLSVQAAKVILPVKLESDWVPVYSGERICQSHREKIPPGIYESLKVEGQVPVRQQSQGADGYYCHKTIYSVLCDFKWYGVKRVRHSVKRDTPSYSECLKAVDDEISGMSEYVGFPPPSCNYLVETRSQNIEIILSKHSVKIDDYKQSWMDSTFLDGGCSHAPCLTTVPGTLWIPTDNLTSACDITFRKQEFTIYYPKQKPAHLSSDQIFITSPYHPVSSLSKSCLITLCGKTGIRLPGGSWSSLDNHKSFHDIKIETLLSNCKSSTEIYSSPPDLRNIRMVWDLERVIENSLCQGTWDKIETRQKITPLDLNYLSPSEPGPGWGFIPKNGSIHKAQILYIRADVDDDTIALGQKYNKGKDEFYFNWNDWELLNGIKIGPNGIITNTHVRIPYYSVGIGKLDEDMITPDEVGVIHHIDHLKQRVLVQTNLDRVWIHEGENGDLITSVSHWWHDVIKHSWEIFALIGGLFSLSCICSLCSCRKKRRESRHQETMSFV

SEQ ID NO: 656 - protein, 523 aa, unidentified
  REGION 1..523: note = community acquired respiratory virus (CARV)
MKMKMVIAGLILCIGILPAIGKITISFPQSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 657 - protein, 530 aa, unidentified
  REGION 1..530: note = Chandipura vesiculovirus (CHPV)
MTSSVTISVILLISFIAPSYSSLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGAIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEMKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 658 - protein, 512 aa, unidentified
  REGION 1..512: note = COCV
MNFLLLTFIVLPLCSHAKFSIVFPQSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 659 - protein, 511 aa, unidentified
  REGION 1..511: note = Indian vesiculovirus (VSIV)
MKCLLYLAFLSIGVNCKFTIVFPHNQKGTWKNVPSNYHYCPSSSDLNWHNDLIGTALQVKMPKSHKAIQADGWMCHASKWVTTCDFRWYGPKYITHSIRSFTPSVEQCRESIEQTKQGTWLNPGFPPQSCGYATVTDAEAVIVQVTPHHVLVDEYTGEWVDSQFINGKCSNDICPTVHNSTTWHSDYKVKGLCDSNLISMDITFFSEDGELSSLGKEGTGFRSNHFAYETGDKACKMQYCKHWGVRLPSGVWFEMADQDLFAAARFPECPEGSSISAPSQTSVDVSLIQDVERILDYSLCQETWSKIGAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIELVEGWFSGWKSSIASFFFIIGLIIGLFLVLRVGIYLCIKLKHTKKRQIYTDIEMNRLGK

SEQ ID NO: 660 - protein, 523 aa, unidentified
  REGION 1..523: note = Isfahan virus (ISFV)
MTSVLFMVGVLLGAFGSTHCSIQIVFPSETKLVWKPVLKGTRYCPQSAELNLEPDLKTMAFDSKVPIGITPSNSDGYLCHAAKWVTTCDFRWYGPKYITHSVHSLRPTVSDCKAAVEAYNAGTLMYPGFPPESCGYASITDSEFYVMLVTPHPVGVDDYRGHWVDPLFPTSECNSNFCETVHNATMWIPKDLKTHDVCSQDFQTIRVSVMYPQTKPTKGADLTLKSKFHAHMKGDRVCKMKFCNKNGLRLGNGEWIEVGDEVMLDNSKLLSLFPDCLVGSVVKSTLLSEGVQTALWETDRLLDYSLCQNTWEKIDRKEPLSAVDLSYLAPRSPGKGMAYIVANGSLMSAPARYIRVWIDSPILKEIKGKKESASGIDTVLWEQWLPFNGMELGPNGLIKTKSGYKFPLYLLGMGIVDQDLQELSSVNPVDHPHVPIAQAFVSEGEEVFFGDTGVSKNPIELISGWFSDWKETAAALGFAAISVILIIGLMRLLPLLCRRRKQKKVIYKDVELNSFDPRQAFHR

SEQ ID NO: 661 - protein, 524 aa, unidentified
  REGION 1..524: note = Jurona virus (JURV)
MESLPFSALLAVLSITLCDSAIPIFFPSEPQLEWKPVLPGSRYCPQSNEMSLDPDLKKSTISVKVPIGVTPSKSDGYLCHGAKWVSTCDFRWYGPKYITHSIHNLRPTTNDCEDAIKKYEAGTLINPGFPPDSCAYATVTDSEHLVILITPHHVGVDDYRGAWVDDSFPSGVCETNQCDTTHNSSIWIPKTKTRHNICSQTFANLSVTISYREGGAMKGADMVFHSKYHPHMVGGHICKMNFCNKQGLRLQNEEWIEIPSGTKVGNQDLMNLFSDCKSGLEVRSTLRSEGANTLTWETQRLLDYALCQNTWDKFDNQGAVSALDLSYLAARAPGKGVAYTMINGTLHSAPTRYVRMWIESPSMEELKAKKESSSGVETSIWNQWFPFKGGEIGPNGLIKAGNKYKFPLYLVGMGMLDDEINALELGGPIDHPQRAHAQAVLGDEETLFFGDTGVGKNPVELITGWFSGWKETIMAVVAIFLLVIVLYGVLRCCPTICVLCKRKSRHRTKDMEMQYIPNNQRHWR

SEQ ID NO: 662 - protein, 521 aa, unidentified
  REGION 1..521: note = Malpais Spring virus (MSPV)
MESLLKAICVLLLIHCSRCDLPIVFPDQKELLWNPVLKTNRYCPQTREIAPLDKPKTLKITTGVPVRSPKEKIEGYLCHSGKWVTTCDYRWYGAKYVTHSIHHLKPTDQMCRDAISQYNGGTLLNPGFPPEVCGYASVTDSELIITLITPHTVGVDDYRGLWIDPSFPNGECNSIVCETIHNSTKWVSKGEMPTDICQQTFTTIKMDVSYPSDTTSQGSLLSFHSPYHPHISGKDICKMSYCGSNGLRLPNGEWFSIINTSKIGNKNLIDFFSPCKAGVEVRSTLQSEGSQTIAWETQRMLDYALCQNTWDKFERGEPLSPLDLNYLAPRVPGKGMAYTIINNTLHSSHAVYRRVWIEGPIIGEMKGKIESATGVAKEIWAQWFEFGQNKIGPNGVIKTNDGIKFPLYAIGTGLIDQDIHELSEVSPMDHPHLVHAKKYVSEDDEIYFGDTGVSHNPVEIFSGWFTNWKEGLMKFSILVLSILIFYVVIRLVMCIPLKCKKERKPRLEFELQPREWEYSRA

SEQ ID NO: 663 - protein, 512 aa, Marburg virus
MLRLFLFCFLALGAHSKFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 664 - protein, 513 aa, unidentified
  REGION 1..513: note = Moriche virus (MORV)
MLVLYLLLSLLALGAQCKFTIVFPHNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 665 - protein, 517 aa, unidentified
  REGION 1..517: note = Vesicular stomatitis New Jersey virus (VSNJV)
MLSYLIFALVVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVRQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 666 - protein, 525 aa, unidentified
  REGION 1..525: note = Porcine endogenous retrovirus (PERV)
MSSKIVLAAICLCSVQYVACSFQIVFPEFNNAAWLPYLKTSRYCPQSAEMEFERRVSTTLLSADVPIGVTPTKSDGYLCHAAKWVTTCDFRWYGPKYVTHSIHDLTPAQVDCHEALARYKAGTLFNPGFPPASCGYATITDSEQKVVMITPHHVGIDDYRGKWIDPIFPGGECTTNYCETLHNSSVWLPADEKIVDICAQTFRKIKVTATYPSEGAVTKETISLHSAYHPHVPGTGICRMTYCSKEGLRLPNGEWLGIFYDNRIKTTDVRTVFPACPDGLEVKSTLNSDGANTIAWETQRMLDYALCQSTWDKVQNKEPLSAVDLSYLSARSPGKGLAYTVINGTLHFAHVRYVRTWIDGPVLKDLKGSRFDPTAAQKTLWDQWFPFGSNEIGPNGLLKTPKDFKFPLYIIGTGLVDEDLQELSEAGPIDHPQIPDASGILPNSEQVYYGDTGVSKNPIELIEGWFANWKETVMSIVGLVLLITIVFTVLKCIGTCRSLRRKRKIEKDIELQEIGPYQPTTYRPR

SEQ ID NO: 667 - protein, 529 aa, unidentified
  REGION 1..529: note = PIRYV
MDLFPILVVVLMTDTVLGKFQIVFPDQNELEWRPVVGDSRHCPQSSEMQFDGSRSQTILTGKAPVGITPSKSDGFICHAAKWVTTCDFRWYGPKYITHSIHHLRPTTSDCETALQRYKDGSLINLGFPPESCGYATVTDSEAMLVQVTPHHVGVDDYRGHWIDPLFPGGECSTNFCDTVHNSSVWIPKSQKTDICAQSFKNIKMTASYPSEGALVSDRFAFHSAYHPNMPGSTVCIMDFCEQKGLRFTNGEWMGLNVEQSIREKKISAIFPNCVAGTEIRATLESEGARTLTWETQRMLDYSLCQNTWDKVSRKEPLSPLDLSYLSPRAPGKGMAYTVINGTLHSAHAKYIRTWIDYGEMKEIKGGRGEYSKAPELLWSQWFDFGPFKIGPNGLLHTGKTFKFPLYLIGAGIIDEDLHELDEAAPIDHPQMPDAKSVLPEDEEIFFGDTGVSKNPIELIQGWFSNWRESVMAIVGIVLLIVVTFLAIKTVRVLNCLWRPRKKRIVRQEVDVESRLNHFEMRGFPEYVKR

SEQ ID NO: 668 - protein, 556 aa, unidentified
  REGION 1..556: note = RADV
MISITFVYLIIILSLSWGEMMIPFPDVTTTTWKPVLKGEHHCPSSSDVDILSRMSTLKLQVRIPTGSVASKSDGLLCHGAKWVTTCDFRWYGSKYITHSLHSIRPTLSQCTEAAKAYKEGRLMAPGFPPESCGWNSVTDSELLSILVTPHHTGVDDYRGIWIDSMFPGGECKEMVCDTVQGHTIWMSTSNLTTACGVAFKQIQGQFYYLNSGHQPNKEGTFFHSPNHPNSPLSTACRKKYCNQEGIVIHTGEWIGVPWNTRIRDVQLDSYTDLCAESTEIKSTIGSAPIRVIAWEMERVMDFALCQTVWDKVNRGDPLSPLDLSYLSSRAPGKGLAYTIINETLHVAHVRYIRTYIKAPIMEEIKGSRGDRSAAESVLWTQWFPYGDGEIGPNGLLKTNGSFKFPFYLVGMGAIDDDLIELSNADPIDHPQKAIASVHLNTDEELFFGNTGSDSNPVEAVEGWFASWKSAGINMALIVLCVLLVLIFLRSLPALIKLIHRYRVSRSRQTDVELNSINETARTGSVGPDIIPGAWRVHDSGVRQSQFFRNNPRRLGP

SEQ ID NO: 669 - protein, 559 aa, unidentified
  REGION 1..559: note = Yug bogdanovic virus (YBV)
MISSTLILVIISAHAFCDMIIPFPDVTTTSWKPVLRGEHHCPASNDLDMAGGLSTLKMNVKIPSGVVGSKSDGYLCHGAKWVTTCDYRWYGAKYITHSLHPLRPSTSQCFDAIKAYREGTLLSPGFPPESCGWNSVTDSELLSIQITPHHSGVDDYRGVWIDSMFPKGECDQRICDTVQEHSIWIAANNVSSACSIAFKQLEGYFYYRNSGIQPNKDGTFFHSSHHPNSPMSSCCRIKYCNQEGLRLHTGEWIGVAWNTKIRDVTLDSYTDTCPGGTEVKSTIGSSPTRVVAWEMERIMDFALCQNVWDKVNRGEQLSPLDLSYLSSRAPGKGLAYTIINETLHVAHVRYIRTWIKGPVLKEIKGRRGSSSAAEDTLWIQWFPFGDNQIGPNGLLKSNGTFKFPFYLVGVGALDEDLIEMANADPVDHLQRVDAETHMRGDEELFFGDTGVSKNPIESVEGWFSNWISGLFNISIIVLCVLSVLIVFKSVITLIRVVRRRRRPRAEEDVELNNMNPRPQTRQPVGAPNIIPGAWGIQPSHGRGVRQSQFVKRSALNIVT

SEQ ID NO: 670 - protein, 511 aa, unidentified
  REGION 1..511: note = VSV CEN AM - 94GUB
MKCLLYLALLFIGVYCKFTTVFPHNKKGDWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSDDICPTVHNSTTWHSDYKVKGLCDSNLISMDITFFSEDGELSSLGKEGTGFRSNYFAYETGDKACKMQYCKHWGVRLPSGVWFEMADKNLFAAAKFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWEDWAPYEDVEIGPNGVLRTSSGYKFPLYMIGHGMLDSDLHLSSKAQVFEHPHIPDATSQLPDDETLFFGDTGLSKDPIELVEGWFSGWKSSIASFFFIIGLIIGLFFVLRIGVYLCIKLKHTNKRQIYTDIEMNRLGK

SEQ ID NO: 671 - protein, 511 aa, unidentified
  REGION 1..511: note = VSV South America 85CLB
MKCLLCLAFLFIGVNCKFTIVFPHNQKGNWKNVPSNYHYCPSSSDLNWHNDLIGTALQVKMPKSHKAIQADGWMCHASKWITTCDFRWYGPKYITHSIQSFTPSVEQCKESIEQTKQGTWLNPGFPPQSCGYATVTDAEAVIVQVTPHHVLVDEYTGEWVDSQFINGKCSNDICLTVHNSTTWHSDYKVKGLCDSNLISMDITFFSEDGELSSLGKAGTGFRSNYFAYETGDKACKMQYCKHWGVRLPSGVWFEMADKDLFAAAKFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTNTERELWEDWAPYEDVEIGPNGVLRTSSGYKFPLYMIGHGMLDSDLHLSSKVQVFEHPHIQDAASQLPDDETLFFGDTGLSKNPIELVEGWFSGWKSSIASFFFIIGLIIGLFLVLRVGIYLCIKLKHTRKRKIYADIEMNRLGK

SEQ ID NO: 672 - protein, 546 aa, unidentified
  REGION 1..546: note = Nipah Virus
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 673 - protein, 602 aa, unidentified
  REGION 1..602: note = Nipah Virus
MPAENKKVRFENTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 674 - protein, 546 aa, unidentified
  REGION 1..546: note = Hendra Virus
MATQEVRLKCLLCGIIVLVLSLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 675 - protein, 603 aa, unidentified
  REGION 1..603: note = Hendra Virus
MADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 676 - protein, 552 aa, Newcastle disease virus
MGSRPSTKNPAPMMLTIRVALVLSCICPANSIDGRPLAAAGIVVTGDKAVNIYTSSQTGSIIVKLLPNLPKDKEACAKAPLDAYNRTLTTLLTPLGDSIRRIQESVTTSGGGRQGRLIGAIIGGVALGVATAAQITAAAALIQAKQNAANILRLKESIAATNEAVHEVTDGLSQLAVAVGKMQQFVNDQFNKTAQELDCIKIAQQVGVELNLYLTELTTVFGPQITSPALNKLTIQALYNLAGGNMDYLLTKLGVGNNQLSSLIGSGLITGNPILYDSQTQLLGIQVTAPSVGNLNNMRATYLETLSVSTTRGFASALVPKVVTQVGSVIEELDTSYCIETDLDLYCTRIVTFPMSPGIYSCLSGNTSACMYSKTEGALTTPYMTIKGSVIANCKMTTCRCVNPPGIISQNYGEAVSLIDKQSCNVLSLGGITLRLSGEFDVTYQKNISIQDSQVIITGNLDISTELGNVNNSISNALNKLEESNRKLDKVNVKLTSTSALITYIVLTIISLVFGILSLILACYLMYKQKAQQKTLLWLGNNTLDQMRATTK

SEQ ID NO: 677 - protein, 577 aa, Newcastle disease virus
MDRAVSQVALENDEREAKNTWRLIFRIAILFLTVVTLAISVASLLYSMGASTPSDLVGIPTRISRAEEKITSTLGSNQDVVDRIYKQVALESPLALLNTETTIMNAITSLSYQINGAANNSGWGAPIHDPDYIGGIGKELIVDDASDVTSFYPSAFQEHLNFIPAPTTGSGCTRIPSFDMSATHYCYTHNVILSGCRDHSHSYQYLALGVLRTSATGRVFFSTLRSINLDDTQNRKSCSVSATPLGCDMLCSKVTETEEEDYNSAVPTRMVHGRLGFDGQYHEKDLDVTTLFGDWVANYPGVGGGSFIDSRVWFSVYGGLKPNSPSDTVQEGKYVIYKRYNDTCPDEQDYQIRMAKSSYKPGRFGGKRIQQAILSIKVSTSLGEDPVLTVPPNTVTLMGAEGRILTVGTSHFLYQRGSSYFSPALLYPMTVSNKTATLHSPYTFNAFTRPGSIPCQASARCPNSCVTGVYTDPYPLIFYRNHTLRGVFGTMLDGVQARLNPASAVFDSTSRSRITRVSSSSTKAAYTTSTCFKVVKTNKTYCLSIAEISNTLFGEFRIVPLLVEILKDDGVREARSG

SEQ ID NO: 678 - protein, 574 aa, unidentified
  REGION 1..574: note = RSV f0
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 679 - protein, 263 aa, unidentified
  REGION 1..263: note = RSV G
MSNHTHHPKFKTLKRAWKASKYFIVGLSCLYKFNLKSLVQTALTSLAMITLTSLVITAIIYISVGNAKAKPTSKPTTQQTQQPQNHTPLLPTEHNHKSTHTSTQSTTLSQPPNIDTTSGTTYGHPINRTQNRKIKSQSTPLATRKLPINPLESNPPENHQDHNNSQTLPHVPCSTCEGNPACSPLCQIGLERAPSRAPTITLKKAPKPKTTKKPTKTTIYHRTSPEAKLQTKKNTATPQQGILSSPEHQTNQSTTQISQHTSI

SEQ ID NO: 680 - protein, 574 aa, unidentified
  REGION 1..574: note = Bovine respiratory syncytial virus (strain Rb94) (BRS)
MATTAMRMIISIIFISTYVTHITLCQNITEEFYQSTCSAVSRGYLSALRTGWYTSVVTIELSKIQKNVCNSTDSNVKLIKQELERYNNAVVELQSLMQNEPASSSRAKRGIPELIHYKRNSTKKFYGLMGKKRKRRFLGFLLGIGSAIASGVAVSKVLHLEGEVNKIKNALLSTNKAVVSLSNGVSVLTSKVLDLKNYIDKELLPKVNNHDCKISNIATVIEFQQKNNRLLEIAREFSVNAGITTPLSTYMLTNSELLSLINDMPITNDQKKLMSSNVQIVRQQSYSIMSVVKEEVMAYVVQLPIYGVIDTPCWKLHTSPLCTTDNKEGSNICLTRTDRGWYCDNAGSVSFFPQAETCKVQSNRVFCDTMNSLTLPTDVNLCNTDIFNAKYDCKIMTSKTDISSSVITSIGAIVSCYGKTKCTASNKNRGIIKTFSNGCDYVSNRGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYSKTRSTPIMLGKDQLSGINNLSFSK

SEQ ID NO: 681 - protein, 537 aa, unidentified
  REGION 1..537: note = Murine pneumonia virus (strain 15) (MPV)
MIPGRIFLVLLVIFNTKPIHPNTLTEKYYESTCSVETAGYKSALRTGWHMTVMSIKLSQINIESCKSSNSLLAHELAIYSSAVDELRTLSSNALKSKRKKRFLGLILGLGAAVTAGVALAKTVQLESEIALIRDAVRNTNEAVVSLTNGMSVLAKVVDDLKNFISKELLPKINRVSCDVHDITAVIRFQQLNKRLLEVSREFSSNAGLTHTVSSFMLTDRELTSIVGGMAVSAGQKEIMLSSKAIMRRNGLAILSSVNADTLVYVIQLPLFGVMDTDCWVIRSSIDCHNIADKYACLARADNGWYCHNAGSLSYFPSPTDCEIHNGYAFCDTLKSLTVPVTSRECNSNMYTTNYDCKISTSKTYVSTAVLTTMGCLVSCYGHNSCTVINNDKGIIRTLPDGCHYISNKGVDRVQVGNTVYYLSKEVGKSIVVRGEPLVLKYDPLSFPDDKFDVAIRDVEHSINQTRTFFKASDQLLDLSENRENKNLNKSYILTTLLFVVMLIIIMAVIGFILYKVLKMIRDNKLKSKSTPGLTVLS

SEQ ID NO: 682 - protein, 550 aa, unidentified
  REGION 1..550: note = Measles virus (strain Edmonston) (MeV) (Subacute sclerose panencephalitis virus)
MGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPISLERLDVGTNLGNAIAKLEDAKELLESSDQILRSMKGLSSTSIVYILIAVCLGGLIGIPALICCCRGRCNKKGEQVGMSRPGLKPDLTGTSKSYVRSL

SEQ ID NO: 683 - protein, 550 aa, unidentified; identical to SEQ ID NO: 682
  REGION 1..550: note = Measles virus (strain Edmonston B) (MeV) (Subacute sclerose panencephalitis virus)

SEQ ID NO: 684 - protein, 574 aa, unidentified
  REGION 1..574: note = Human respiratory syncytial virus B (strain B1)
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 685 - protein, 546 aa, unidentified
  REGION 1..546: note = Rinderpest virus (strain RBOK) (RDV)
MKILFATLLVVTTPHLVTGQIHWGNLSKIGVVGTGSASYKVMTQSSHQTLVIKLMPNITAIDNCTKTEIEEYKRLLGTVLQPIKVALNAITKNIKPIKSSTTSRRHRRFAGVALAGAALGVATAAQITAGIALHQSMMNTQAIESLKASLETTNQAIEEIRQAGQEMILAVQGVQDYINNELVPAMGQLSCDIVGQKLGLKLLRYYTEILSLFGPSLRDPISAEISIQALSYALGGDINKILEKLGYSGSDLLAILESKGIKAKITYVDIESYFIVLSIAYPSLSEIKGVIIHRLEGVSYNIGSQEWYTTVPRYVATQGYLISNFDDTPCAFSPEGTICSQNALYPMSPLLQECFRGSTRSCARTLVSGSIGNRFILSKGNLIANCASILCKCYTTGSIISQDPDKILTYIAADQCPIVEVDGVTIQVGSREYPDAVYLHKIDLGPPISLEKLDVGTNLGNAVTKLEKAKDLLDSSDLILETIKGASVTNTGHILVGAGLIAVVGILIVTCCCRKRSNDSKVSTVILNPGLKPDLTGTSKSYVRSL

SEQ ID NO: 686 - protein, 561 aa, unidentified
  REGION 1..561: note = Simian virus 41 (SV41)
MRLTPYPIALTTLMIALTTLPETGLGIARDALSQVGVIQSKARSLMYYSDGSSSFIVVKLLPTLPTPSGNCNLTSITAYNTTLFKLLTPLMENLDTIVSANQAGSRRKRFAGVVVGLAALGVATAAQVTAAVAVVKANANAAAINKLAASIQSTNAAISDVISSTRTLATAIQAVQDHVNGVLASGLTEANCRSQDALIGSILNLYLTELTTIFHNQIVNPALTPLSIQALRIILGSTLPLIVESRWNTNLNTAELLSSGLLTGQIISISPSYMQMVIQITVPTFVMQPGAKIIDLVTITANRMEEEVLIQVPPRILEYANEIQAYTADDCVVTPHAVFCKYNDGSPISDSLYQCLKGNLTSCVFTPVVGNYLKRFAFANGVMYVNCKALLCRCADPPMVITQDDLAGITVIDITVCREVMLDTLAFKITSLNNVTYGANFSMLAAAIKDLSPLDLSAQLAQVNKSLASAEEKIAQSSSLAAQAVSQEATITVGSVAMLIAVLALIAGCTGIMIAVQMSRRLEVLRHLTDQSIISNHHYAELNPPPYNHSYESLHPIPQSH

SEQ ID NO: 687 - protein, 538 aa, unidentified
  REGION 1..538: note = Mumps virus (strain Miyahara vaccine) (MuV)
MKVFLVTCLGFAVFSSSVCVNINILQQIGYIKQQVRQLSYYSQSSSSYIVVKLLPNIQPTDNSCEFKSVTQYNKTLSNLLLPIAENINNIASPSSGSRRHKRFAGIAIGIAALGVATAAQVTAAVSLVQAQTNARAIAAMKNSIQATNRAVFEVKEGTQRLAIAVQAIQDHINTIMNTQLNNMSCQILDNQLATSLGLYLTELTTVFQPQLINPALSPISIQALRSLLGSMTPAVVQATLSTSISAAEILSAGLMEGQIVSVLLDEMQMIVKINIPTIVTQSNALVIDFYSISSFINNQESIIQLPDRILEIGNEQWSYPAKNCKLTRHHIFCQYNEAERLSLESKLCLAGNISACVFSPIAGSYMRRFVALDGTIVANCRSLTCLCKSPSYPIYQPDHHAVTTIDLTACQTLSLDGLDFSIVSLSNITYAENLTISLSQTINTQPIDISTELSKVNASLQNAVKYIKESNHQLQSVNVNSKIGAIIVAALVLSILSIIISLLFCCWAYVATKEIRRINFKTNHINTISSSVDDLIRY

SEQ ID NO: 688 - protein, 662 aa, unidentified
  REGION 1..662: note = Canine distemper virus (strain Onderstepoort) (CDV)
MHRGIPKSSKTQTHTQQDRPPQPSTELEETRTSRARHSTTSAQRSTHYDPRTSDRPVSYTMNRTRSRKQTSHRLKNIPVHGNHEATIQHIPESVSKGARSQIERRQPNAINSGSHCTWLVLWCLGMASLFLCSKAQIHWDNLSTIGIIGTDNVHYKIMTRPSHQYLVIKLIPNASLIENCTKAELGEYEKLLNSVLEPINQALTLMTKNVKPLQSLGSGRRQRRFAGVVLAGVALGVATAAQITAGIALHQSNLNAQAIQSLRTSLEQSNKAIEEIREATQETVIAVQGVQDYVNNELVPAMQHMSCELVGQRLGLRLLRYYTELLSIFGPSLRDPISAEISIQALIYALGGEIHKILEKLGYSGSDMIAILESRGIKTKITHVDLPGKFIILSISYPTLSEVKGVIVHRLEAVSYNIGSQEWYTTVPRYIATNGYLISNFDESSCVFVSESAICSQNSLYPMSPLLQQCIRGDTSSCARTLVSGTMGNKFILSKGNIVANCASILCKCYSTSTIINQSPDKLLTFIASDTCPLVEIDGATIQVGGRQYPDMVYEGKVALGPAISLDRLDVGTNLGNALKKLDDAKVLIDSSNQILETVRRSSFNFGSLLSVPILSCTALALLLLIYCCKRRYQQTLKQHTKVDPAFKPDLTGTSKSYVRSL

SEQ ID NO: 689 - protein, 574 aa, unidentified
  REGION 1..574: note = Human respiratory syncytial virus A (strain Long)
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYASNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 690 - protein, 565 aa, unidentified
  REGION 1..565: note = Sendai virus (strain Fushimi) (SeV)
MTAYIQRSQCISTSLLVVLTTLVSCQIPRDRLSNIGVIVDEGKSLKIAGSHESRYIVLSLVPGVDLENGCGTAQVIQYKSLLNRLLIPLRDALDLQEALITVTNDTTQNAGVPQSRFFGAVIGTIALGVATSAQITAGIALAEAREAKRDIALIKESMTKTHKSIELLQNAVGEQILALKTLQDFVNDEIKPAISELGCETAALRLGIKLTQHYSGLLTAFGSNFGTIGEKSLTLQALSSLYSANITEIMTTIRTGQSNIYDVIYTEQIKGTVIDVDLERYMVTLSVKIPILSEVPGVLIHKASSISYNIDGEEWYVTVPSHILSRASFLGGADITDCVESRLTYICPRDPAQLIPDSQQKCILGDTTRCPVTKVVDSLIPKFAFVNGGVVANCIASTCTCGTGRRPISQDRSKGVVFLTHDNCGLIGVNGVELYANRRGHDATWGVQNLTVGPAIAIRPIDISLNLADATNFLQDSKAELEKARKILSEVGRWYNSRETVITIIVVMVVILVVIIVIVIVLYRLKRSMLMGNPDDRIPRDTYTLEPKIRHMYTNGGFDAMAEKR

SEQ ID NO: 691 - protein, 574 aa, unidentified
  REGION 1..574: note = Human respiratory syncytial virus A (strain RSS-2)
MELPILKTNAITAILAAVTLCFASSQNITEEFYQSTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKDRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 692 - protein, 546 aa, unidentified
  REGION 1..546: note = Rinderpest virus (strain RBT1) (RDV)
MRIPLAALIAMTIPCLATGQIHWGNLSKIGVVGTSSASYKVVTQSSHQSLVIKLMPNITAIDNCTKTEIGEYKRLLGTVLKPIGEALNAITKNIKPIQSSTTSRRHKRFAGVVLAGAALGVATAAQITAGIALHQSMMNSQAIESLKASLVTTNQAIEEIRQAGQEMILAVQGVQDYINNELVPAMGQLSCDMVGQKLGLKLLRYYTEILSLFGPSLRDPVSAEISIQALSYALGGDINKILNRLGYSGSDLLAILESKGIKAKITYVDIESYFIVLSIAYPSLSEIKGVIVHRLEGVSYNIGSQEWYTTVPRYVATQGYLISNFDDTPCAFTPEGTISSQNALYPMSPLLQECFRGSTRSCARTLVSGSIGNRFILSKGNLIANCASILCKCYTTGSIISQDPDKILTYIAADQCPVVEVNGVTIQVGSREYPDAVYLHNIDLGPPISLEKLDVGTDLGNAVTKLERAKDLLDSSDLILKNIKGVSVTNTGYILIGVGLIAVVGIIIVTCCCKKSSSDSRASTVVLNPGLKPDLTGTSKSYIRSL

SEQ ID NO: 693 - protein, 550 aa, unidentified; identical to SEQ ID NO: 682
  REGION 1..550: note = Measles virus (strain Leningrad-16) (MeV) (Subacute sclerose panencephalitis virus)

SEQ ID NO: 694 - protein, 551 aa, Human parainfluenza virus 2
MHHLHPMIVCIFVMYTGIVGSDAIAGDQLLNIGVIQSKIRSLMYYTDGGASFIVVKLLPNLPPSNGTCNITSLDAYNVTLFKLLTPLIENLSKISTVTDTKTRQKRFAGVVVGLAALGVATAAQITAAVAIVKANANAAAINNLASSIQSTNKAVSDVIDASRTIATAVQAIQDHINGAIVNGITSASCRAHDALIGSILNLYLTELTTIFHNQITNPALTPLSIQALRILLGSTLPIVIESKLNTNLNTAELLSSGLLTGQIISISPMYMQMLIQINVPTFIMQPGAKVIDLIAISANHKLQEVVVQVPNRILEYANELQNYPANDCVVTPNSVFCRYNEGSPIPESQYQCLRGNLNSCTFTPIIGNFLKRFAFANGVLYANCKSLLCRCADPPHVVSQDDTQGISIIDIKRCSEMMLDTFSFRITSTFNATYVTDFSMINANIVHLSPLDLSNQINSINKSLKSAEDWIADSNFFANQARTAKTLYSLSAIALILSVITLVVVGLLIAYIIKLVSQIHQFRSLAATTMFHRENPAFFSKNNHGNIYGIS

SEQ ID NO: 695 - protein, 537 aa, unidentified
  REGION 1..537: note = Avian metapneumovirus (isolate Canada goose/Minnesota/15a/2001) (AMPV)
MSWKVVLLLVLLATPTGGLEESYLEESCSTVTRGYLSVLRTGWYTNVFTLEVGDVENLTCTDGPSLIRTELELTKNALEELKTVSADQLAKEARIMSPRKARFVLGAIALGVATAAAVTAGVAIAKTIRLEGEVAAIKGALRKTNEAVSTLGNGVRVLATAVNDLKDFISKKLTPAINKNKCDISDLKMAVSFGQYNRRFLNVVRQFSDNAGITPAISLDLMTDAELVRAVSNMPTSSGQINLMLENRAMVRRKGFGILIGVYGSSVVYMVQLPIFGVIDTPCWKVKAAPLCSGKDGSYACLLREDQGWYCQNAGSTVYYPNEEDCEVRSDHVFCDTAAGINVAKESEECNRNISTTKYPCKVSTGRHPISMVALSPLGALVACYDGVSCSIGSNKVGIIRPLGKGCSYISNQDADTVTIDNPVYQLSKVEGEQHTIKGKPVSSNFDPIEFPEDQFNIALDQVFESVEKSKNLIDQSNKILDSTEKGNAGFVMVIVLIVLLMLAAVGVGIFFVVKKRKAAPKFPMEMNGVNNKGFIP

SEQ ID NO: 696 - protein, 537 aa, Phocine distemper virus
MVILVHCVMGQIHWTNLSTIGIIGTDSSHYKIMTRSSHQYLVLKLMPNVSIIDNCTKAELDEYEKLLNSVLEPINQALTLMTKNVKSLQSLGSGRRQRRFAGVVIAGAALGVATAAQITAGVALYQSNLNAQAIQSLRASLEQSNKAIDEVRQASQNIIIAVQGVQDYVNNEIVPALQHMSCELIGQRLGLKLLRYYTELLSVFGPSLRDPISAEISIQALSYALGGEIHKILEKLGYSGNDMVAILETKGIRAKITHVDLSGKFIVLSISYPTLSEVKGVVVHRLEAVSYNIGSQEWYTTVPRYVATNGYLISNFDESSCVFVSESAICSQNSLYPMSPILQQCLRGETASCARTLVSGTLGNKFILSKGNIIANCASILCKCHSTSKIINQSPDKLLTFIASDTCSLVEIDGVTIQVGSRQYPDVVYASKVILGPAISLERLDVGTNLGSALKKLDDAKVLIESSDQILDTVKNSYLSLGTLIALPVSIGLGLILLLLICCCKKRYQHLFSQSTKVAPVFKPDLTGTSKSYVRSL

SEQ ID NO: 697 - protein, 565 aa, unidentified
  REGION 1..565: note = Sendai virus (strain Harris) (SeV)
MTAYIQRSQCISTSLLVVLTTLVSCQIPRDRLSNIGVIVDEGKSLKIAGSHESRYIVLSLVPGVDLENGCGTAQVIQYKSLLNRLLIPLRDALDLQEALITVTNDTTQNAGVPQSRFFGAVIGTIALGVATSAQITAGIALAEAREAKRDIALIKESMTKTHKSVELLQNAVGEQILALKTLQDFVNDEIKPAISELGCETAALRLGIKLTQHYFGLLTAFGSNFGTIGEKSRTLQALSSLYSANITEIMTTIRTGQSNIYDVIYTEQIKGTVIDVDLERYMVTLSVKIPILSEVPGVLIHKASSISYNIDGEEWYVTVPSHILSRASFLGGADITDCVESRLTYICPRDPAQLIPDSQQKCILGDTTRCPVTKVVDSLIPKFAFVNGGVVANRIASTCTCGTGRRPISQDRSKGVAFLTHDNCGLIGVNGVELYANRRGHDATWGVQNLTVGPAIAIRPVDISLNLADATNFLQDSKAELEKARKILSEVGRWYNSRETVITIIVVMVVILVVIIVIVIVLYRLKRSMLMGNPDERIPRDTYTLEPKIRHMYTNGGFDAMAEKR

SEQ ID NO: 698 - protein, 540 aa, Bovine parainfluenza virus 3
MIITNTIIIILIISPSFCQIDITKLQRVGVLVNNPKGMKISQNFETRYLILSLIPKIENSHSCGDQQINQYKKLLDRLIIPLYDGLKLQKDVIVVSHETNNNTNSRTKRFFGEIIGTIAIGIATSAQITAAVALVEAKQAKSDIEKLKEAIRDTNKAVQSIQSSVGNLIVAVKSVQDYVNNEIVPSITRLGCEAAGLKLGIALTQHYSELTNIFGDNIGTLKEKGIKLQGIASLYHTNITEIFTTSTVDQYDIYDLLFTESIKMRVIDVDLSDYSITLQVRLPLLTKISNTQIYKVDSISYNIQGKEWYIPLPNHIMTKGAFLGGADIKECIEAFSSYICPSDPGFTLNHEIENCLSGNITQCPKTIVTSDVVPRYAFVNGGLIANCITTTCTCNGVDNRINQSPDQGIKIITHKECQVIGINGMLFSTNREGTLATYTFDDIILNNSVALNPIDISMELNKAKLELEESKEWIKKSNQKLDSVGSWYQSSATITIIIVMIVVLFIINITIIVVIIRHHRIQGKNQNDKNSEPYVLTSRQ

SEQ ID NO: 699 - protein, 550 aa, unidentified; identical to SEQ ID NO: 682
  REGION 1..550: note = Measles virus (strain Ichinose-B95a) (MeV) (Subacute sclerose panencephalitis virus)

SEQ ID NO: 700 - protein, 553 aa, unidentified
  REGION 1..553: note = Human parainfluenza 2 virus (strain Toshiba) (HPIV-2)
MGSRPSTKIPAPMMLTIRVALVLSCICPANSIDGRPLAAAGIVVTGDKAVNIYTSSQTGSIIVKLLPNLPKDKEACAKAPLDAYNRTLTTLLTPLGDSIRRIQESVTTSGGGRQGRLIGAIIGGVALGVATAAQITAAAALIQAKQNAANILRLKESIAATNEAVHEVTDGLSQLAVAVGKMQQFVNDQFNKTAQELDCIKIAQQVGVELNLYLTELTTVFGPQITSPALNKLTIQALYNLAGGNMDYLLTKLGIGNNQLSSLIGSGLITGNPILYDSQTQLLGIQVTLPSVGNLNNMRATYLETLSVSTTRGFASALVPKVVTQVGSVIEELDTSYCIETDLDLYCTRIVTFPMSPGIYSCLSGNTSACMYSKTEGALTTPYMTIKGSVIANCKMTTCRCVNPPGIISQNYGEAVSLIDKQSCNVLSLGGITLRLSGEFDVTYQKNISIQDSQVIITGNLDISTELGNVNNSISNALNKLEESNRKLDKVNVKLTSTSALITYIVLTIISLVFGILSLILACYLMYKQKAQQKTLLWLGNNTLDQMRATTKM

SEQ ID NO: 701 - protein, 553 aa, unidentified; identical to SEQ ID NO: 700
  REGION 1..553: note = Newcastle disease virus (strain B1-Hitchner/47) (NDV)

SEQ ID NO: 702 - protein, 534 aa, unidentified
  REGION 1..534: note = Measles virus (strain Yamagata-1) (MeV) (Subacute sclerose panencephalitis virus)
MGLRVNVSAIFMAVLLTLQTPTGQIHWGNLSKIGVVGIGSASYKVMTRSSHQSLVIKLMPNTTLLNNCTRVEIAEYRRLLRTVLEPIRDALNAMTQNIRPVQIVASSRRHKRFAGVVLAGAALGVATAAQITAGIALHQSMLNSQAIDNLRASLETTNQAIEAIRQTGQEMILAVQGVQDYINNELIPSMNQLSCDLIGQKLGLKLLRYYTEILSLFGPSLRDPISAEISIQALSYVLGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTHIAADHCPVVEVNGVTIQVGSRRYPDAVYLHRIDLGPPISLERLDVGTSLGSAIAKLEDAKELLESSDQILRSMKGLSSTSIVYILIAVCLGGLIGIPALICCCRGRCNKRENKLVCQDQA

SEQ ID NO: 703 - protein, 529 aa, unidentified
  REGION 1..529: note = Measles virus (strain IP-3-Ca) (MeV) (Subacute sclerose panencephalitis virus)
MSIMGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRLVQSVASSRRHKRFAGVVLAGAALGVATAAQITAGIALHQSMLSSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKEVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIIRQDPDKILTYIAADHCPVVEVNGVTIQVGSRRYPDAVDLHRIDLGPPISLERLDVGTNLGSAIAKLEDAKELLESSDQILRSMKGLSSTSIVYILIAVCLGGLIGIPALICCCRGRCNKKGE

SEQ ID NO: 704 - protein, 550 aa, unidentified
  REGION 1..550: note = Measles virus (strain Edmonston-AIK-C vaccine) (MeV) (Subacute sclerose panencephalitis virus)
MGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYLIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPILLERLDVGTNLGNAIAKLEDAKELLESSDQILRSMKGLSSTCIVYILIAVCLGGLIGIPALICCCRGRCNKKGEQVGMSRPGLKPDLTGTSKSYVRSL

SEQ ID NO: 705 - protein, 538 aa, Turkey rhinotracheitis virus
MDVRICLLLFLISNPSSCIQETYNEESCSTVTRGYKSVLRTGWYTNVFNLEIGNVENITCNDGPSLIDTELVLTKNALRELKTVSADQVAKESRLSSPRRRRFVLGAIALGVATAAAVTAGVALAKTIRLEGEVKAIKNALRNTNEAVSTLGNGVRVLATAVNDLKEFISKKLTPAINQNKCNIADIKMAISFGQNNRRFLNVVRQFSDSAGITSAVSLDLMTDDELVRAINRMPTSSGQISLMLNNRAMVRRKGFGILIGVYDGTVVYMVQLPIFGVIETPCWRVVAAPLCRKEKGNYACILREDQGWYCTNAGSTAYYPNKDDCEVRDDYVFCDTAAGINVALEVEQCNYNISTSKYPCKVSTGRHPVSMVALTPLGGLVSCYESVSCSIGSNKVGIIKQLGKGCTHIPNNEADTITIDNTVYQLSKVVGEQRTIKGAPVVNNFNPILFPEDQFNVALDQVFESIDRSQDLIDKSNDLLGADAKSKAGIAIAIVVLVILGIFFLLAVIYYCSRVRKTKPKHDYPATTGHSSMAYVS

SEQ ID NO: 706 - protein, 551 aa, unidentified
  REGION 1..551: note = Human parainfluenza 2 virus (strain Greer) (HPIV-2)
MHHLHPMIVCIFVMYTGIVGSDAIAGDQLLNIGVIQSKIRSLMYYTDGGASFIVVKLLPNLPPSNGTCNITSLDAYNVTLFKLLTPLIENLSKISTVTDTKTRQKRFAGVVVGLAALGVATAAQITAAVAIVKANANAAAINNLASSIQSTNKAVSDVIDASRTIATAVQAIQDHINGAIVNGITSASCRAHDALIGSILNLYLTELTTIFHNQITNPALTPLSIQALRILLGSTLPIVIESKLNTNLNTAELLSSGLLTGQIISISPMYMQMLIQINVPTFIMQPGAKVIDLIAISANHKLQEVVVQVPNRILEYANELQNYPANDCVVTPNSVCCRYNEGSPIPESQYQCLRGNLNSCTFTPIIGNFLKRFAFANGVLYANCKSLLCRCADPPHVVSQDDTQGISIIDIKRCSEMMLDTFSFRITSTFNATYVTDFSMINANIVHLSPLDLSNQINSINKSLKSAEDWIADSNFFANQARTAKTLYSLSAIALILSVITLVVVGLLIAYIIKLVSQIHQFRSLAATTMFHRENPAFFSKNNHGNIYGIS

SEQ ID NO: 707 - protein, 546 aa, unidentified; identical to SEQ ID NO: 674
  REGION 1..546: note = Hendra virus (isolate Horse/Autralia/Hendra/1994)

SEQ ID NO: 708 - protein, 539 aa, unidentified
  REGION 1..539: note = Human metapneumovirus (strain CAN97-83) (HMPV)
MSWKVVIIFSLLITPQHGLKESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 709 - protein, 574 aa, unidentified
  REGION 1..574: note = Bovine respiratory syncytial virus (strain Copenhagen) (BRS)
MAATAMRMIISIIFISTYMTHITLCQNITEEFYQSTCSAVSRGYLSALRTGWYTSVVTIELSKIQKNVCKSTDSKVKLIKQELERYNNAVIELQSLMQNEPASFSRAKRGIPELIHYTRNSTKRFYGLMGKKRKRRFLGFLLGIGSAIASGVAVSKVLHLEGEVNKIKNALLSTNKAVVSLSNGVSVLTSKVLDLKNYIDKELLPKVNNHDCRISNIETVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 710 - protein, 565 aa, unidentified
  REGION 1..565: note = Sendai virus (strain Z) (SeV) (Sendai virus (strain HVJ))
MTAYIQRSQCISTSLLVVLTTLVSCQIPRDRLSNIGVIVDEGKSLKIAGSHESRYIVLSLVPGVDFENGCGTAQVIQYKSLLNRLLIPLRDALDLQEALITVTNDTTQNAGAPQSRFFGAVIGTIALGVATSAQITAGIALAEAREAKRDIALIKESMTKTHKSIELLQNAVGEQILALKTLQDFVNDEIKPAISELGCETAALRLGIKLTQHYSELLTAFGSNFGTIGEKSLTLQALSSLYSANITEIMTTIKTGQSNIYDVIYTEQIKGTVIDVDLERYMVTLSVKIPILSEVPGVLIHKASSISYNIDGEEWYVTVPSHILSRASFLGGADITDCVESRLTYICPRDPAQLIPDSQQKCILGDTTRCPVTKVVDSLIPKFAFVNGGVVANCIASTCTCGTGRRPISQDRSKGVVFLTHDNCGLIGVNGVELYANRRGHDATWGVQNLTVGPAIAIRPIDISLNLADATNFLQDSKAELEKARKILSEVGRWYNSRETVITIIVVMVVILVVIIVIIIVLYRLRRSMLMGNPDDRIPRDTYTLEPKIRHMYTNGGFDAMAEKR

SEQ ID NO: 711 - protein, 539 aa, unidentified
  REGION 1..539: note = Human parainfluenza 3 virus (strain Wash/47885/57) (HPIV-3) (Human parainfluenza 3 virus (strain NIH 47885))
MPTSILLIITTMIMASFCQIDITKLQHVGVLVNSPKGMKISQNFETRYLILSLIPKIEDSNSCGDQQIKQYKRLLDRLIIPLYDGLRLQKDVIVSNQESNENTDPRTKRFFGGVIGTIALGVATSAQITAAVALVEAKQARSDIEKLKEAIRDTNKAVQSVQSSIGNLIVAIKSVQDYVNKEIVPSIARLGCEAAGLQLGIALTQHYSELTNIFGDNIGSLQEKGIKLQGIASLYRTNITEIFTTSTVDKYDIYDLLFTESIKVRVIDVDLNDYSITLQVRLPLLTRLLNTQIYRVDSISYNIQNREWYIPLPSHIMTKGAFLGGADVKECIEAFSSYICPSDPGFVLNHEMESCLSGNISQCPRTVVKSDIVPRYAFVNGGVVANCITTTCTCNGIGNRINQPPDQGVKIITHKECNTIGINGMLFNTNKEGTLAFYTPNDITLNNSVALDPIDISIELNKAKSDLEESKEWIRRSNQKLDSIGNWHQSSTTIIIVLIMIIILFIINVTIIIIAVKYYRIQKRNRVDQNDKPYVLTNK

SEQ ID NO: 712 - protein, 538 aa, unidentified
  REGION 1..538: note = Mumps virus (strain SBL-1)
MKAFPVICLGFAIFSSSICVNINILQQIGYIKQQVRQLSYYSQSSSSYVVVKLLPNIQPTDNSCEFKSVTQYNKTLSNLLLPIAENINNITSPSPGSRRHKRFAGIAIGIAALGVATAAQVTAAVSLVQAQTNARAIAAMKNSIQATNRAVFEVKEGTQQLAIAVQAIQDHINTIMNTQLNNMSCQILDNQLATSLGLYLTELTTVFQPQLINPALSPISIQALRSLLGSMTPAVVQATLSTSISAAEILSAGLMEGQIVSVLLDEMQMIVKINVPTIVTQSNALVIDFYSISSFINNQESIIQLPDRILEIGNEQWRYPAKNCKLTRHHIFCQYNEAERLSLETKLCLAGNISACVFSSIAGSYMRRFVALDGTIVANCRSLTCLCKSPSYPIYQPDHHAVTTIDLTSCQTLSLDGLDFSIVSLSNITYAENLTISLSQTINTQPIDISTELSKVNASLQNAVKYIKESNHQLQSVSVSSKIGAIIVAALVLSILSIIISLLFCFWAYIATKEIRRINFKTNHINTISSSVDDLIRY

SEQ ID NO: 713 - protein, 550 aa, unidentified; identical to SEQ ID NO: 682
  REGION 1..550: note = Measles virus (strain Edmonston-Zagreb vaccine) (MeV) (Subacute sclerose panencephalitis virus)

SEQ ID NO: 714 - protein, 555 aa, unidentified
  REGION 1..555: note = Human parainfluenza 1 virus (strain C39) (HPIV-1)
MQKSEILFLIYSSLLLSSSLCQIPVDKLSNVGVIINEGKLLKIAGSYESRYIVLSLVPSIDLEDGCGTTQIIQYKNLLNRLLIPLKDALDLQESLITITNDTTVTNDNPQSRFFGAVIGTIALGVATAAQITAGIALAEAREARKDIALIKDSIIKTHNSVELIQRGIGEQIIALKTLQDFVNNEIRPAIGELRCETTALKLGIKLTQHYSELATAFSSNLGTIGEKSLTLQALSSLYSANITEILSTIKKDKSDIYDIIYTEQVKGTVIDVDLEKYMVTLLVKIPILSEIPGVLIYRASSISYNIEGEEWHVAIPNYIINKASSLGGADVTNCIESRLAYICPRDPTQLIPDNQQKCILGDVSKCPVTKVINNLVPKFAFINGGVVANCIASTCTCGTNRIPVNQDRSRGVTFLTYTNCGLIGINGIELYANKRGRDTTWGNQIIKVGPAVSIRPVDISLNLASATNFLEESKIELMKAKAIISAVGGWHNTESTQIIIIIIVCILIIIICGILYYLYRVRRLLVMINSTHNSPVNTYTLESRMRNPYIGNNSN

SEQ ID NO: 715 - protein, 565 aa, unidentified
  REGION 1..565: note = Sendai virus (strain Hamamatsu)
MATYIQRVQCISALLSVVLTTLVSCQIPRDRLSNIGVIVDEGKSLKIAGSHESRYIVLSLVPGVDLENGCGTAQVIQYKSLLNRLLIPLRDALDLQEALITVTNDTMTSADVPQSRFFGAVIGTIALGVATSAQITAGIALAEAREAKRDIALIKESMTKTHKSIELLQNAVGEQILALKTLQDFVNDEIKPAISELGCETAALRLGIKLTQHYSELLTAFGSNFGTIGEKSLTLQALSSLYSANITEIMTTIRTGQSNIYDVIYTEQIKGTVIDVDLERYMVTLSVKIPILSEVPGVLIHKASSISYNIDGEEWYVTVPSHILSRASFLGGANIADCVESRLTYICPRDPAQLIPDSQQKCILGDTTRCPVTKVVDNLIPKFAFVNGGVVANCIASTCTCGTGRRPISQDRSKGVVFLTHDNCGLIGVNGIELYANRKGHDATWGVQNLTVGPAIAIRPVDISLNLAAATDFLQDSRAELEKARKILSEVGRWYNSGATLITIIVVMIVVLVVIIVIVIVLYRLRRSMLMSNPAGRISRDTYTLEPKIRHMYTNGGFDAMTEKR

SEQ ID NO: 716 - protein, 538 aa, unidentified
  REGION 1..538: note = Mumps virus (strain RW) (MuV)
MKAFSVTCLGFAVFSSSICVNINILQQIGYIKQQVRQLSYYSQSSSSYIVVKLLPNIQPTDNSCEFKSVTQYNKTLSNLLLPIAENINNIASPSPGSRRHKRFAGIAIGIAALGVATAAQVTAAVSLVQAQTNARAIAAMKNSIQATNRAIFEVKEGTQQLAIAVQAIQDHINTIMNTQLNNMSCQILDNQLATYLGLYLTELTTVFQPQLINPALSPISIQALRSLLGSMTPAVVQATLSTSISAAEILSAGLMEGQIVSVLLDEMQMIVKINIPTIVTQSNALVIDFYSISSFINNQESIIQLPDRILEIGNEQWSYPAKNCKLTRHHIFCQYNEAERLSLESKLCLAGNISACVFSPIAGSYMRRFVALDGTIVANCRSLTCLCKSPSYPIYQPDHHAVTTIDLTTCQTLSLDGLDFSIVSLSNITYAENLTISLSQTINTQPIDISTELSKVNASLQNAVKYIKESNHQLQSVSVNSKIGAIIVAALVLSILSIIISLLFCCWAYIATKEIRRINFKTNHINTISSSVDDLIRY

SEQ ID NO: 717 - protein, 508 aa, unidentified
  REGION 1..508: note = Infectious hematopoietic necrosis virus (strain Oregon69) (IHNV)
MDTTITTPLILILITCGANSQTVKPDTASESDQPTWSNPLFTYPEGCTLDKLSKVNASQLRCPRIFDDENRGLIAYPTSIRSLSVGNDLGDIHTQGNHIHKVLYRTICSTGFFGGQTIEKALVEMKLSTKEAGAYDTTTAAALYFPAPRCQWYTDNVQNDLIFYYTTQKSVLRDPYTRDFLDSDFIGGKCTKSPCQTHWSNVVWMGDAGIPACDSSQEIKGHLFVDKISNRVVKATSYGHHPWGLHQACMIEFCGKQWIRTDLGDLISVEYNSGAEILSFPKCEDKTVGMRGNLDDFAYLDDLVKASESREECLEAHAEIISTNSVTPYLLSKFRSPHPGINDVYAMHKGSIYHGMCMTVAVDEVSKDRTTYRAHRATSFTKWERPFGDEWEGFHGLHGNNTTIIPDLEKYVAQYKTSMMEPMSIKSVPHPSILALYNETDVSGISIRKLDSFDLQSLHWSFWPTISALGGIPFALLLAVAACCCWSGRPPTPSASQSIPMYHLANRS

SEQ ID NO: 718 - protein, 561 aa, unidentified
  REGION 1..561: note = Drosophila melanogaster sigma virus (isolate Drosophila/USA/AP30/2005) (DMelSV)
MAHYELHVLFVHSWMLALILITTLVWLAASQKAFTPDLVFPEMNRNSSWSVANYGEILCPTSFQSYDPKKHQILTRVLVERPSLNTDTKVEGYTCHKVKYETICDMPWYFSPTISHSISPLRVKESECKDAIAEHQLGTHVPLSFPPEDCSWNSVNTKEYEDIIVKEHPVMLDPYTNNYVDAIFPGGISSPGMGGTIHDDMMWVSKDLAVSPECSGWQRSMGLIYSSRLYGEREPMLEVGSIHIEGHRDKNLTLACRISFCGEIGVRFHDGEWMKVSVNLDHPNSVTFQVTDFPPCPPGTTIQTAVVENINPEIQELTVNMMYRLKCQETISKMVSGLPTSALDLSYLIQVQEGPGIVYKREKGILYQSVGMYQYIDTVTLNKEENQLGENSRGQKVFWTEWSDSPTRPGLQEGINGIVKYEGQVRVPLGMSLRLEAATELMWGHPVHTVSHPILHVISNHTEQSVTTWNRGVNSTNLIGLATRSISGFYDNLKLYLILALIFVSLIALVVLDVIPFKYILFVLCPPLLLCRFIKCSRRKPETRDRYHVEYNRPGQVSSAF

SEQ ID NO: 719 - protein, 508 aa, unidentified
  REGION 1..508: note = Hirame rhabdovirus (strain Korea/CA 9703/1997) (HIRRV)
MDPRIMYYTVLLTTAARVYGQTIKPGVDSVSDQPTWANPLFTYPVDCPAAKLSKVSPSQLRCPRIFDDENRGLVAYPAVIRSLSVGNNLGDIHTQGEYVHKVLYRTTCSTGFFGGQTIEKALVEMKLAPREVGVYDTTTASALYFPAPRCQWYTDNVHNDLTFYYTTAKSVLRDPYTLGFLDSDFIEGKCSKSPCQTHWSNVVWKGDSGVAACDTGSEIKGHIFVDKTSHHVVKATSYGHHPWGLHRACMITFCGKPWIRTDLGDLIAIEYNGGATLLAFPACKDTTVGMRGSLDDFAYLDDLVKSSESREECLEAHAEIIATNSVTPYLLSKFRSPHPGINDVYAMHDGSIYHGKCMTVAIDEVSKDRRTYRAHQTSAFVAWGHPFGDEWGGFHGLHGNDTPVIPDLEKYVAQYKVSMMDKMDIRPVPHPSVQILYNDTDTADITIRKIDSFDLQSLNWSFWPSLSALGGVPILLALVFFLYCCMNRRPSMPAAPQEIPMYHLASRG

SEQ ID NO: 720 - protein, 632 aa, Sonchus yellow net virus
MSHIMNLLVISFVLAGSSWSLLGYQDDFSSKRSGALASNPTYNLPQDKGYGRDMYQPYYICEPDNDGSALTLPSWHYSCKESCMGNHLKRVVNITGARWNYVGISIPVFKIVTNEVCYTSHENVWGYCSQYQISRPVATQKSDVSCITSSMWDNDKSPIGSLYNIVNSNEAECDYFSDITDCNRDYQIFKREGKLIKRSDDSPLELSIVTDGIRTDPASEYLSLDDVSWFWKLPNNDMSPPCGWEKTQKLSCSYTDTTDVIKCNSIGYTYNIQGISKKSTCAGNIYDTDGPFPFFYDAEEALMSTDDACGKAKQGKPDADIAFIEGVNRAFEDLELTYCSATCDLFARQGTPNEDHVLDTPIGTWRYVMRDNLDPALVPCLPTSNWTISDPTTICHGKDHILVVDTATGHSGSWDTKKDYIITGEVCNTNNDEMGDDYDGMRDKILRGETIEIKFWTGDIIRMAPPYDNPEWIKGSVLFRQNPGWFSSVELNKDMIHTRDNITDLLTVMVQNATAEVMYKRLDPKTMKHILFAEIVDGVGNVSGKISGFLTGLFGGFTKAVIIVASLAICYIVLSVLWKVRLVASIFNSAKKKRVRISDILDEEPHRIQQSRPTLSRKKKTRESIQMLLNDI

SEQ ID NO: 721 - protein, 524 aa, unidentified
  REGION 1..524: note = European bat lyssavirus 1 (strain Bat/Germany/RV9/1968) (EBLV1)
MLLSTAIFAFFLNCAPCLAKFPIYTIPDKIGPWSPIDINHLSCPNNLIVEDEGCTTLTPFSYMELKVGYITTIKIEGFTCTGVITEAETYTNFVGYVTTTFKRKHFRPTVSACRDAYNWKITGDPRYEESLHNPYPDSHWLRTVKTTKESLLIISPSVVDMDAYDKNLYSKMFPNGKCLASPPSAICCPTNHDYTIWIPENPKPGLSCDIFTTSKGKKATKDGRLCGFVDERGLYKSLKGACKQRLCGVPGMRLMDGSWVSLQKTEAPEWCSPDQLVNVHDFHTDEIEHLVVEELVKKREECLDALETIITTKSISFRRLSHFRKLVPGFGKAYTLINKTLMEADAHYKSVREWKEVIPSKGCLMAGGRCHPHYSGIFFNGIILSPGGDVLIPEMQSALLQQHIELLESSMIPLRHPLADPSTVFKRDDEAEDFVEVHLPDTQKLISGIDLGFPEWKRYFLIGISVLALLALAIITAACCKRFKRRRRPKPNPIELIRKVSVTSQSGRAIPSWESYKVGATGES

SEQ ID NO: 722 - protein, 522 aa, Lagos bat virus
MSQLNLIPFFCVIIVLSVEDFPLYTIPEKIGPWTPIDLIHLSCPNNLQSEDEGCGTSSVFSYVELKTGYLTHQKVSGFTCTGVVNEAVTYTNFVGYVTTTFKRKHFKPTALACRDAYHWKISGDPRYEESLHTPYPDNSWLRTVTTTKESLVIISPSIVEMDVYSRTLHSPMFPTGTCSRFYPSSPSCATNHDYTLWLPDDPNLSLACDIFVTSTGKKSMNGSRMCGFTDERGYYRTIKGACKLTLCGKPGLRLFDGTWISFPRPEVTTRCLPNQLVNIHNNRIDEVEHLIVEDLIRKREECLDTLETVLMSKSISFRRLSHFRKLVPGYGKAYTILNGSLMETNVHYLKVDNWSEILPSKGCLKINNQCVAHYKGVFFNGIIKGPDGHILIPEMQSSLLKQHMDLLKAAVFPLKHPLIEPGSLFNKDGDADEFVDVHMPDVHKLVSDVDLGLPDWSLYALIGATIIAFFILICLIRICCKKGGRRNSPTNRPDLPIGLSTTPQPKSKVISSWESYKGTSNV

SEQ ID NO: 723 - protein, 533 aa, Duvenhage virus
MPLNAVIFTLLLRCSICLGKFPFYTIPDKLGPWSPIDIHHLSCPNNLVVEDEGCTTLTPFSYMELKVGYITSIKVSGFTCTGVVTEAETYTNFVGYVTTTFRRRHFRPSVNSCRDAYNWKIAGDPRYEESLHNPYPDSHWLRTVKTTKESLLIISPSVADMDAYDKKLYSKIVSNGRCSEISPGSPFCPTNHEYTIWMPESSNPGISCDIFTRSMGKKATKDGQLCGFVDERGLYKSLKGACRLRLCGISGLRLMDGSWVSLPQVNNSEWCSPDQLVNIHDFHSDEIEHLVADELVKKREDCLDALETILFTKSISFRRLSHLRKLVPGFGKAYTIINRTLMEAEAHYKSVREWKEIIPSKGCLKAGGRCYPHHNGIFFNGIILGPGGEILIPEMQSALLQQHIELLESSVVPLKHPLADPSTVFKNDDEAESFVDVHLPDTNQKISGIDLGLPEWKRYFLIGVSAVALLALSIIIAVCCKRFRKRKKSKPGPVELTRKVSVISKGNGPVPSWESYKEGTTGDVRNTTPSTRE

SEQ ID NO: 724 - protein, 525 aa, unidentified
  REGION 1..525: note = West Caucasian bat virus (WCBV)
MASYFALVLNGISMVFSQGLFPLYTIPDHLGPWTPIDLSHLHCPNNLYTDASYCTTEQSITYTELKVGSSVSQKIPGFTCTGVRTESVTYTNFVGYVTTTFKKKHFPPKSRDCREAYERKKAGDPRYEESLAHPYPDNSWLRTVTTTKDSWVIIEPSVVELDIYTSALYSPLFKDGTCSKSRTYSPYCPTNHDFTIWMPESENIRSACNLFSTSRGKLVRNRTSTCGIIDERGLFRSVKGACKISICGRQGIRLVDGTWMSFRYSEYLPVCSPSQLINTHDIKVDELENAIVLDLIRRREECLDTLETILMSGSVSHRRLSHFRKLVPGSGKAYSYINGTLMESDAHYIKVENWSEVIPHKGCLMVGGKCYEPVNDVYFNGIIRDSNNQILIPEMQSSLLREHVDLLKANIVPFRHPMLLRSFTSDTEEDIVEFVNPHLQDTQKLVSDMDLGLSDWKRYLLIGSLAVGGVVAILFIGTCCLRCRAGRNRRTIRSNHRSLSHDVVFHKDKDKVITSWESYKGQTAQ

SEQ ID NO: 725 - protein, 524 aa, unidentified
  REGION 1..524: note = European bat lyssavirus 2 (strain Human/Scotland/RV1333/2002) (EBLV2)
MPFQAVLSALLSALTLCVGKFPIYTIPDKLGPWSPIDIHHLSCPNNIVVEDEGCTTLTVFSYMELKVGYITTIKVNGFTCTGVVTEAETYTNFVGYVTTTFKRKHFRPSPSACRDAYSWKTAGDPRYEESLHNPYPDSHWLRTVTTTKESVLIISPSVADMDAYDKTLYSKIFLNGKCSGVSQVSPFCSTNHDYTIWMPENPNPGVSCDIFTTSKGKKATKDGKLCGFVDERGLYKSLKGACKLKLCGISGMRLMDGSWVSIQNHDEAKWCSPDQLVNIHDFHSDEVEHLIAEELVKKREECLDALESIMTTKSISFRRLSHLRKLVPGFGKAYTIINKTLMEADAHYKSIREWTDVIPSKGCLMAGGRCYPHHNGVFFNGIILSPDGHVLIPEMQSAMLQQHIELLESSVIPLMHPLADPSTIFKKDDGAEDFVEVHLPDVQKQISGIDLGLPEWKRYFLIGVSALAFLALMIFIAACCRRVKRKKRAKPNPVELIRKVSVTSQSGRPIPSWESYKVETGGQS

SEQ ID NO: 726 - protein, 524 aa, unidentified
  REGION 1..524: note = Irkut virus (IRKV)
MSLLTAVIAFLFISTFCSGKFPIYTIPDKIGPWSPIDINHLSCPNNLEVEDEGCTTLTAFNYMELKVGYITSIKVDGFTCTGVVTEAETYTNFVGYVTTTFKRKHFRPNVSACRAAFSWKTAGDPRYEESLHNPYPDSHWLRTVTTTKESLLIISPSVVDMDAYDKTLYSKMFPNGKCFPPISDSPFCSTNHDYTLWLPEKEKLSMSCNIFVSSKGKKATKDGRLCGFVDERGLYKSLKGACKLKLCGMAGMRLMDGSWVSLQRADAPEWCPPGALVNVHDFHSDEIAHFVVEELIKKREECLDTLETILTTKSISFRRLSHFRKLVPGLGKAYTLINNTLMEAEAHYKSIREWKEIIPSKGCLKAGGRCHPHYDGIFFNGIILGPNGDVLIPEMQSSLLQQHIELLESSMIPLRHPLADSSAIFRSDNEAEDFVDVHLPDTQKQVSDIDLGFPEWKRYFLIGVSAIALFSLAIIIAVCCRKFKRRKRPKPGPIELVRKVSVTSQSGKVVPSWESYKEGATSQP

SEQ ID NO: 727 - protein, 531 aa, unidentified
  REGION 1..531: note = Tupaia virus (isolate Tupaia/Thailand/-/1986) (TUPV)
MAPQTISLLWAMVCVSVYTRANRVVAPIHEPQNWKPATVDDFTCRTGFNLDFDSKFIKTKALVLKRVGQAKVKGYLCMKNRWTTTCETNWLYSKSVSHHITHVAVSAEECYNKIRDDASGNLKIESYPNPQCAWSSTVSREEDFIHISTSDVGYDMYTDTVLSPSFPGGTCKLKTCCKTIYPNIVWVPETPAQTQVRDALFDETMVTVTVEAKKVVKDSWVTGATITPSVMEGSCKKTLGSKSGILLPNGQWFSIVETGQITIQPKGSVEEKETWVNLINDLNLSDCAETQEAKVPTAEFTVYKTESMVFNILNYHLCLETVAKARSGKNLTRLDLARLAPEIPGVAHVYQLTSDGVRVGSTRYEIIAWKPTMGLDKTLGLTIVPSGNRNSETIKWIEWTRTDDGLLNGPNGIFIADGKEIVHPNLKMVSFELETYLISEHSTQLVPHPVIHSISDEIYPENYTIGGKNSYIKIHTPTAYFWSGIHWIEGAVQKLFIVVVATALIGLFILVVWLCCGCCSKSRPVRNQKWE

SEQ ID NO: 728 - protein, 524 aa, unidentified; identical to SEQ ID NO: 613
  REGION 1..524: note = Rabies virus (strain ERA) (RABV)

SEQ ID NO: 729 - protein, 263 aa, unidentified
  REGION 1..263: note = Ovine respiratory syncytial virus (strain WSU 83-1578) (ORSV)
MSNHTHHFEFKTLKKAWKASKYFIVGLSCLYKLNLKSLVQMALSALAMITLVSLTITAIIYISTGNTKAKPMPTPTIQITQQFQNHTSLPPTEHNHNSTHSPTQGTTSPHTFAVDVTEGTRYYHLTLKTQGGKTKGPPTPHATRKPPISSQKSNPSEIQQDYSDFQILPYVPCNICEGDSACLSLCQDRSESILDKALTTTPKKTPKPMTTKKPTKTSTHHRTSLRNKLYIKTNMTTPPHGLISTAKHNKNQSTVQNPRHTLA

SEQ ID NO: 730 - protein, 297 aa, unidentified
  REGION 1..297: note = Human respiratory syncytial virus A (strain rsb5857)
MSKTKDQRTAKTLERTWDTLNHLLFISSCLYKLNLKSIAQITLSILAMIISTSLIIAAIIFIASANHKVTLTTAIIQDATSQIKNTTQTYLTQNTQLGISFSNLSETTSQPTTTPALTTPSAKSTPQSTTVKTKNTTTTQIQPSKPTTKQRQKKPPNKPNNDFHFEVFNFVPCSICSNNPTCWAICKRIPNKKPGKKTTTKPTKKPTIKTTKKDLKPQTTKPKEVLTTKPTEKPTINTTRTNIRTTLLTTNTTGNPEYTSQKETLHSTSPEGNPSPSQVYTTSEYPSQPPSPSNTTN

SEQ ID NO: 731 - protein, 529 aa, Piry virus; identical to SEQ ID NO: 667

SEQ ID NO: 732 - protein, 298 aa, unidentified
  REGION 1..298: note = Human respiratory syncytial virus A (strain rsb6190)
MSKTKDQRTAKTLEKTWDTLNHLLFISSCLYKLNLKSIAQITLSILAMIISTSLIIAAIIFIASANNKVTLTTAIIQDATSQIKNTTPTYLTQNPQLGISFFNLSGTTSQTTAILALTTPSVESILQSTTVKTKNTTTTQIQPSKPTTKQRQNKPPNKPNNDFHFEVFNFVPCSICSNNPTCWAICKRIPSKKPGKKTTTKPTKKPTIKTTKKDHKPQTTKPKEAPSTKPTEKPTINITKPNIRTTLLTNSTTGNLEHTSQEETLHSTSSEGNTSPSQVYTTSEYLSQPTSPSNITNQ

SEQ ID NO: 733 - protein, 524 aa, unidentified; identical to SEQ ID NO: 593
  REGION 1..524: note = Rabies virus (strain SAD B19) (RABV)

SEQ ID NO: 734 - protein, 526 aa, unidentified
  REGION 1..526: note = Australian bat lyssavirus (isolate Human/AUS/1998)
MLLQIVLLMSLMVFSPCPGKFPLYTIPDKLGPWSPIDIHHLSCPNNLIVEDEGCTSLSGFSYMELKVGFITTIKVSGFTCTGVVTESETYTNFFGYVTTTFKRKHFRPTPEFCRNAYNWKVAGDPRYEESLHNPYPDYHWLRTVTTTKESLLIISPSVVDMDPYDKSLHSKMFPKGTCSGASVPSIFCSTNHDYTLWMPENPKPGMSCDIFTTSKGKKASKGGKVCGFVDERGLYKSLKGACKLKLCGISGLRLMDGSWVSIQNHEEAKWCSPDQLVNIHDFHSDEIEHLIVEELVRKREECLDALESIMTTKSVSFRRLSHLRKLVPGFGKAYTIVNKTLMEADAHYKSVRTWNEIIPSKGCLKVRERCHPPYNGVFFNGIILSPDGHVLIPEMQSSLLQQHVELLESSVIPLIHPLADPSTVFKRDDEAEDFIEVHLPDVQKQVSGIDLGLSEWERYLIIGASAVVLFALAIIFAVCCRRCKRRKKARTDRIELDRKVSVTSQSGKVIPSWESYKIEAGGHFRS

SEQ ID NO: 735 - protein, 524 aa, unidentified; identical to SEQ ID NO: 615
  REGION 1..524: note = Rabies virus (strain Vnukovo-32)

SEQ ID NO: 736 - protein, 526 aa, unidentified
  REGION 1..526: note = Aravan virus
MPLQAIPLFSLILPVLVAGKFPIYTIPDKIGPWSPIDINHLSCPNNLVVEDEGCTTLTAFSYMELKVGYITTIKVSGFTCTGVVTEAETYTNFVGYVTTTFRRKHFRPTASACREAYNWKATGDPRYEESLHNPYPDSHWLRTVKTTKESLLIISPSVADMDAYDKALYSKIFPNGKCLGVSLSSPFCSTNHDYTLWMPENPKPGVSCDIFTTSKGKKATKDGKLCGFVDERGLYKSLKGACKLKLCGVMGLRLMDGSWVSLQKTEESEWCSPNQLINIHDFHSDEIEHMVVEELVKKREECLDALESIMTTKSISFRRLSHLRKLVPGFGKAYTLINKTLMEADAHYKSVREWTEVIPSKGCLKAGGGCYPHYNRVFFNGIILSPDGHVLIPEMQSALLQQHIELLESSVIPLRHPLADPSTVFKGDDEAEEFVEVHLPDTQKQISGIDLGLPEWKRYFLMGMSAIGFLALTIILAVCCRRIKRRKQSKPNPVELIRKVSVTSQSGRAIPSWESYKVKTGDQPQV

SEQ ID NO: 737 - protein, 526 aa, Sigma virus
MLALIFITTSVWLAASQKTFTPDLVFPEMNRNSSWSVANYGEILCPTSFQSYEPKKHQILTRVLVERPSLNTDTKVEGYTCHKVKYETICDMPWYFSPTISHSISPLRVKESECKDAIAEHQLGTHVSLSFPPEDCSWNSVNTKAYEDIIVKDHPVMLDPYTNNYVDAIFPGGISSPGMGGTIHDDMMWVSKDLAVSPECSGGNKVWGLFIHLGCMGGGSRCWKSAPPHRGPQGQEPHFSLPVSFYNKIGVRFHDGEWMKVSVNLDHPNSVTFQVTDFPPCPPGTTIQTAVVENINPEIQELTVNMMYRLKCQETISKMVSGLPTSVFDLSYLIQVQEGPSIVYKREKGVLYQSVGMYQYIDTVTLNTEENQLGENARGQKVFWTEWSDSPTRPDPQEGSNGFFKYEGQIRVPLGMSLRLEAATELMWGHPVHTVSHPILHVISNHTEQSVTTWNRGVNSTNLIGQATRSISGFYNDLKLYLILALIVVSIVALVVLDVIPFKYILFILCPPLLLCRFIKCSTKEA

SEQ ID NO: 738 - protein, 507 aa, unidentified
  REGION 1..507: note = Viral hemorrhagic septicemia virus (strain 07-71)
MEWNTFFLVILIIIIKSTTPQITQRPPVENISTYHADWDTPLYTHPSNCRDDSFVPIRPAQLRCPHEFEDINKGLVSVPTRIIHLPLSVTSVSAVASGHYLHRVTYRVTCSTSFFGGQTIEKTILEAKLSRQEATDEASKDHEYPFFPEPSCIWMKNNVHKDITHYYKTPKTVSVDLYSRKFLNPDFIEGVCTTSPCQTHWQGVYWVGATPKAHCPTSETLEGHLFTRTHDHRVVKAIVAGHHPWGLTMACTVTFCGTEWIKTDLGDLIQVTGPGGTRKLTPNKCVNTDIQMRGATDDFSYLNHLITNMAQRTECLDAHSDITASGKVSSFLLSKFRPSHPGPGKAHYLLDGQIMRGDCDYEAVVSINYNRAQYKTMNNTWKSWKRVDNNTDGYDGMIFGDKLIIPDIEKYQSVYDSGMLVQRNLVEVPHLSIVFVSNTSDLSTNHIHTNLIPSDWSFNWSLWPSLSGMGVVGGAFLLLVLCCCCKASPPIPNYGIPMQQFSRSQTV

SEQ ID NO: 739 - protein, 524 aa, unidentified; identical to SEQ ID NO: 616
  REGION 1..524: note = Rabies virus (strain Pasteur vaccins / PV)

SEQ ID NO: 740 - protein, 257 aa, unidentified
  REGION 1..257: note = Bovine respiratory syncytial virus (strain Rb94)
MSNHTHHLKFKTLKRAWKASKYFIVGLSCLYKFNLKSLVQTALTTLAMITLTSLVITALIYISVGNAKAKPTSKPTIQQTQRPQNHTSPLFTEHNYKSTHTSIQSTTLSQLLNIDTTRGTTYSHPTDETQNRKIKSQSTLPATRQPPINPSGSNPPENHQDHNNSQTLPYVPCSTCEGNLACSSLCQIGLERAPSRAPTITLKKAPKPKTTKKPTKTTIHHRTSPEAKLQPKNNTAAPQQGILSSPEHHTNQSTTQI

SEQ ID NO: 741 - protein, 662 aa, unidentified
  REGION 1..662: note = Tibrogargan virus (strain CS132) (TIBV)
MEAITIEIIIIILTISYPILVAPQLLYNYPFNCKKGPKMTLDGLTCPLDFNTFNLDSKDNMEAGTMCRPNPLSKDIEDGFLCYKDTWVTTCEETWYFSKTVKNHIIHEHITKDECFEALATYKLGKHVEPFFPAPSCYWSATNEERATFVNIQPHGVLLDPYSGKIKDPLIDSDNCDNDFCVTRSHQTHWLRNRKPDIMERCNNETWECHPIKIYYGWVSKKKNQETSTTFNYVQTGLVIESQYIGHVLMADLCIMTFCNRDGYLFPDGSWWEIKYSLYHAFTKDHTVLNNAHKCGDRTHGDHLTEFQRDKKVGYEDLEINLEGLEMRQKSRSINMMCLNRLAEIRNTHHINVLDMSYLTPKHPGRGLAYYFSQDQKNSSKYHVKVLDCDYKLIHIHDADIKGFVNITKYPEPNVTILGLKDNLTFADLGISRCQDLTPLNGSRNISCEESSGPLHSDDSRLSNGKRFWTRHSFQGANFHEHPGVRIGVNGITYDIRKQILRFPSTSNLLWDLPSYYSTKHRVHFFQHPTKHEIRKNFTGSDSRDIDVLDDLINRHINRTDFPTRIRNWIGNIEDKVEHFFSNVGGTIKTIISLVLFVIGTLISIKVWKKCKRHPQKTKKVAQLKLNDYEKTYNQRDTSNNNNDDLYETIENGGTVYSPFHV

SEQ ID NO: 742 - protein, 508 aa, unidentified
  REGION 1..508: note = Infectious hematopoietic necrosis virus (strain Round Butte) (IHNV)
MDTMITTPLILILITCGANSQTVKPDTASESDQPTWSNPLFTYPEGCTLDKLSKVNASQLRCPRIFDDENRGLIAYPTSIRSLSVGNDLGEIHTQGNHIHKVLYRTICSTGFFGGQTIEKALVEMKLSTKEAGAYDTTTAAALYFPAPRCQWYTDNVQNDLIFYYTTQKSVLRDPYTRDFLDSDFIGGKCTKSPCQTHWSNVVWMGDAGIPACDSSQEIKAHLFVDKISNRVVKATSYGHHPWGLHRACMIEFCGKQWIRTDLGDLISVEYNSGAEILSFPKCEDKTMGMRGNLDDFAYLDDLVKASESREECLEAHAEIISTNSVTPYLLSKFRSPHPGINDVYAMHKGSIYHGMCMTVAVDEVSKDRTTYRAHRATSFTKWERPFGDEWEGFHGLHGNNTTIIPDLEKYVAQYKTSMMEPMSIKSVPHPSILAFYNETDLSGISIRKLDSFDLQSLHWSFWPTISALGGIPLVLLLAVAACCCWSGRPPTPSAPQSIPMYHLANRS

SEQ ID NO: 743 - protein, 292 aa, unidentified
  REGION 1..292: note = Human respiratory syncytial virus B (strain 18537)
MSKHKNQRTARTLEKTWDTLNHLIVISSCLYRLNLKSIAQIALSVLAMIISTSLIIAAIIFIISANHKVTLTTVTVQTIKNHTEKNISTYLTQVPPERVNSSKQPTTTSPIHTNSATISPNTKSETHHTTAQTKGRITTSTQTNKPSTKSRSKNPPKKPKDDYHFEVFNFVPCSICGNNQLCKSICKTIPSNKPKKKPTIKPTNKPTTKTTNKRDPKTPAKMPKKEIITNPAKKPTLKTTERDTSISQSTVLDTITPKYTIQQQSLHSTTSENTPSSTQIPTASEPSTLNPN

SEQ ID NO: 744 - protein, 660 aa, Adelaide River virus
MATFKVLVLMILWITSIFNVRCEKFVTIPVNCSGEVDIDKMDVMCPNRYNLLSTNHLMEGEEVETFCRPSLRENDLLDGYLCRKQKWEVTCTETWYFVTDVKYQIIEVIPTENECMEERERKLKGEYIPPYYPPTNCVWNAIDTQERTFITLIEHPVIEDPVTMTLMDSKFTKPCNPKHNEVTICDTYNPLIKWISKETSGLNLHCQIKSWECIPVKLHHSHRNMMEALYLESPDFGIVDASKICNLTFCGYNGILLDNGEWWSIYRSGFTHGFLDNHILKNRRIEECKEKKPGYKLAKLDTTYIDLEFEIELEHEKCLGTLEKLQNGEYVTPLDLSYLSPSNPGKHYAYRLEYINTTEHKCVQLGFTYEGGDCRKMLDERDDHGAYYNWTTIKLQRVIRAVCYYHTFSMNLDESKHKYYDQDNRSIQIDEKFISEVLKSTPLIDRHEKYEGNLSWNGIIIESKNGHEKNVIVPSASQYNHVMINKILKRLDTVMYDSYKFDSESGSISYNKIVPIVREDNLQNAHRVDVIQYIKDKGSYIINGFTGWFSSLGKLMRWTIWGVGLFFSIFTLYKIIMILRKHSNDNVRKEFKETAGKVMIGQPIDTKSMSRTSIKANNKGKFDKVKDLFTPRSKTISHLTTDTLKEHTDGTYEELHFFNV

SEQ ID NO: 745 - protein, 525 aa, unidentified
  REGION 1..525: note = Australian bat lyssavirus (isolate Bat/AUS/1996) (ABLV)
MLLQVILLVSLTAILPCTGQFPLYAIPDKLGPWSPIDIHHLSCPNNLIVEDEGCTSLSGFSYMELKVGFITTIKVSGFTCTGVVTESETYTNFFGYVTTTFKRKHFRPTPESCRKAYNWKIAGDPRYEESLHNPYPDYHWLRTVTTTKESLLIISPSVVDMDPYDKSLHSRMFPKGSCSGASIPSVFCSTNHDYTLWMPEDSNSGMSCDIFTMSKGKKASKGGKVCGFVDERGLYKSLKGACKLKLCGISGLRLLDGSWVSIQNHEEVKWCSPNQLVNIHDFNADEIEHLIVEELIKEREECLDALESIITTKSVSFRRLSHLRKLVPGFGKAYTIINKTLMEADAHYKSVRTWDEIIPSKGCLKVREKCHPPYNGVFFNGIILGPDGQVLIPEMQSSLLHQHTELLESSVIPLIHPLADPSTIFRGDDEAEGFIEVHLPDIQKQVSGIDLGLSEWERYLIIGISAIILFILAIIFTICCRRCKRRKKIRTDHIELDRKVSVTSQSGKSIPSWESYKSRQGHSRS

SEQ ID NO: 746 - protein, 623 aa, unidentified
  REGION 1..623: note = Bovine ephemeral fever virus (strain BB7721) (BEFV)
MFKVLIITLLVNKIHLEKIYNVPVNCGELHPVKAHEIKCPQRLNELSLQAHHNLAKDEHYNKICRPQLKDDAHLEGFICRKQRWITKCSETWYFSTSIEYQILEVIPEYSGCTDAVKKLDQGALIPPYYPPAGCFWNTEMNQEIEFYVLIQHKPFLNPYDNLIYDSRFLTPCTINDSKTKGCPLKDITGTWIPDVRVEEISEHCNNKHWECITVKSFRSELNDKERLWEAPDIGLVHVNKGCLSTFCGKNGIIFEDGEWWSIENQTESDFQNFKIEKCKGKKPGFRMHTDRTEFEELDIKAELEHERCLNTISKILNKENINTLDMSYLAPTRPGRDYAYLFEQTSWQEKLCLSLPDSGRVSKDCNIDWRTSTRGGMVKKNHYGIGSYKRAWCEYRPFVDKNEDGYIDIQELNGHNMSGNHAILETAPAGGSSGNRLNVTLNGMIFVEPTKLYLHTKSLYEGIEDYQKLIKFEVMEYDNVEENLIRYEEDEKFKPVNLNPHEKSQINRTDIVREIQKGGKKVLSAVVGWFTSTAKAVRWTIWAVGAIVTTYAIYKLYKMVKSNSSHSKHREADLEGLQSTTKENMRVEKNDKNYQDLELGLYEEIRSIKGGSKQTGDDRFFDH

SEQ ID NO: 747 - protein, 523 aa, unidentified; identical to SEQ ID NO: 660
  REGION 1..523: note = Isfahan virus (ISFV)

SEQ ID NO: 748 - protein, 524 aa, unidentified; identical to SEQ ID NO: 622
  REGION 1..524: note = Rabies virus (strain silver-haired bat-associated)

SEQ ID NO: 749 - protein, 512 aa, Snakehead rhabdovirus
MTLPNMKPKRIVLFLVFLNAWVSNAQVTHKPRPDSIVEYSEEWENPIYTTPSHCFEDTFAPVKPEKLRCPHIFDDQNLGLTASKAKILHMDLKPEDTHFEAKGRLLHKVTYQVLCSTGFFGGRTVTRKVLETPMGDNEAQAYKAVDREFPYFPEPLCFWLRDNVAAERVFHFSTPKTVTVDLYSRKYISPDFVGGQCAKSPCPTHWPNVYWVGETQSPECPSIDTEGGHIFTKKDTHRITKAVVHGHHPWGLTKACQIQFCNEQWIRTDLGDLIRIEPNDGTSSLTLPKCQDNVVQMRGNLDDFSYLNHAIVNMAQRSECLEAHSSIVAQQKVSPYLLSKFRPPHPGLGKAHYLQNNTIMRGDCIYEGVAEISENRTTYRNLKGEWKKWSLSRGGEGYDGMTVGTKIVIPDLEKYQSIYDNGMFIPKLLGEVPHPSIVITYNQTDSIETGIFTDGKLLNMGVNWTLWPSLSGISLFTVASLILIWYCCCRVTPQALNYSIPMHTITSRGVEI

SEQ ID NO: 750 - protein, 508 aa, unidentified
  REGION 1..508: note = Infectious hematopoietic necrosis virus (strain WRAC) (IHNV)
MDTMITTPLILILITCGANSQTVKPDTASESDQPTWSNPLFTYPEGCTLDKLSKVNASQLRCPRIFDDENRGLIAYPTSIRSLSVGNDLGDIHTQGNHIHKVLYRTICSTGFFGGQTIEKALVKMKLSTKEAGAYDTTTAAALYFPAPRCQWYTDNVQNDLIFYYTTQKSVLRDPYTRDFLDSDFIGGKCTKSPCQTHWSNVVWMGDAGIPACDSSQEIKAHLFVDKISNRVVKATSYGHHPWGLHQACMIEFCGQQWIRTDLGDLISVVYNSGSEILSFPKCEDKTVGMRGNLDDFAYLDDLVKASESREECLEAHAEIISTNSVTPYLLSKFRSPHPGINDVYAMHKGSIYHGMCMTVAVDEVSKDRTTYRAHRATSFTKWERPFGDEWEGFHGLHGNNTTIIPDLEKYVAQYKMSMMEPMSIKSVPHPSILALYNETDVSGISIRKLDSFDLQSLHWSFWPTISALGGIPFVLLLAVAACCCWSGRPPTPSVPQSIPMYHLANRS

SEQ ID NO: 751 - protein, 676 aa, unidentified
  REGION 1..676: note = Zaire ebolavirus (strain Kikwit-95) (ZEBOV) (Zaire Ebola virus)
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTAVSNRAKNISGQSPARTSSDPGTNTTTEDHKIMASENSSAMVQVHSQGREAAVSHLTTLATISTSPQPPTTKPGPDNSTHNTPVYKLDISEATQVEQHHRRTDNDSTASDTPPATTAAGPLKAENTNTSKGTDLLDPATTTSPQNHSETAGNNNTHHQDTGEESASSGKLGLITNTIAGVAGLITGGRRARREAIVNAQPKCNPNLHYWTTQDEGAAIGLAWIPYFGPAAEGIYTEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIPAGIGVTGVIIAVIALFCICKFVF

SEQ ID NO: 752 - protein, 372 aa, unidentified
  REGION 1..372: note = Sudan ebolavirus (strain Maleo-79) (SEBOV) (Sudan Ebola virus)
MEGLSLLQLPRDKFRKSSFFVWVIILFQKAFSMPLGVVTNSTLEVTEIDQLVCKDHLASTDQLKSVGLNLEGSGVSTDIPSATKRWGFRSGVPPQVVSYEAGEWAENCYNLEIKKPDGSECLPPPPDGVRGFPRCRYVHKAQGTGPCPGDYAFHKDGAFFLYDRLASTVIYRGVNFAEGVIAFLILAKPKETFLQSPPIREAANYTENTSSYYATSYLEYEIENFGAQHSTTLFKINNNTFVLLDRPHTPQFLFQLNDTIQLHQQLSNTTGKLIWTLDANINADIGEWAFWENKKISPNNYVEKSCLSKLYRSTRQKTMMRHRRELQREESPTGPPGSIRTWFQRIPLGWFHCTYQKGKQHCRLRIRQKVEE

SEQ ID NO: 753 - protein, 365 aa, unidentified
  REGION 1..365: note = Tai Forest ebolavirus (strain Cote d'Ivoire-94) (TAFV) (Cote d'Ivoire Ebola virus)
MGASGILQLPRERFRKTSFFVWVIILFHKVFSIPLGVVHNNTLQVSDIDKFVCRDKLSSTSQLKSVGLNLEGNGVATDVPTATKRWGFRAGVPPKVVNYEAGEWAENCYNLAIKKVDGSECLPEAPEGVRDFPRCRYVHKVSGTGPCPGGLAFHKEGAFFLYDRLASTIIYRGTTFAEGVIAFLILPKARKDFFQSPPLHEPANMTTDPSSYYHTTTINYVVDNFGTNTTEFLFQVDHLTYVQLEARFTPQFLVLLNETIYSDNRRSNTTGKLIWKINPTVDTSMGEWAFWENKKTSQKPFQVKSCLSYLYQKPRTRSLTRQRRSLLPSPPTTTQAKTTKNWFQRIPLQWFRCKTSRERTQCQPQ

SEQ ID NO: 754 - protein, 677 aa, unidentified
  REGION 1..677: note = Reston ebolavirus (strain Philippines-96) (REBOV) (Reston Ebola virus)
MGSGYQLLQLPRERFRKTSFLVWVIILFQRAISMPLGIVTNSTLKATEIDQLVCRDKLSSTSQLKSVGLNLEGNGIATDVPSATKRWGFRSGVPPKVVSYEAGEWAENCYNLEIKKSDGSECLPLPPDGVRGFPRCRYVHKVQGTGPCPGDLAFHKNGAFFLYDRLASTVIYRGTTFAEGVIAFLILSEPKKHFWKATPAHEPVNTTDDSTSYYMTLTLSYEMSNFGGEESNTLFKVDNHTYVQLDRPHTPQFLVQLNETLRRNNRLSNSTGRLTWTVDPKIEPDVGEWAFWETKKNFSQQLHGENLHFQILSTHTNNSSDQSPAGTVQGKISYHPPTNNSELVPTDSPPVVSVLTAGRTEEMSTQGLTNGETITGFTANPMTTTIAPSPTMTSEVDNNVPSEQPNNTASIEDSPPSASNETIDHSEMNSIQGSNNSAQSPQTKATPAPTASPMTLDPQETANISKPGTSPGSAAGPSQPGLTINTISKVADSLSPTRKQKRSVRQNTANKCNPDLHYWTAVDEGAAAGLAWIPYFGPAAEGIYIEGVMHNQNGLICGLRQLANETTQALQLFLRATTELRTYSLLNRKAIDFLLQRWGGTCRILGPSCCIEPHDWTKNITDEINQIKHDFIDNPLPDHGDDLNLWTGWRQWIPAGIGIIGVIIAIIALLCICKILC

SEQ ID NO: 755 - protein, 681 aa, unidentified
  REGION 1..681: note = Lake Victoria marburgvirus (strain Angola/2005) (MARV)
MKTTCLLISLILIQGVKTLPILEIASNIQPQNVDSVCSGTLQKTEDVHLMGFTLSGQKVADSPLEASKRWAFRAGVPPKNVEYTEGEEAKTCYNISVTDPSGKSLLLDPPTNIRDYPKCKTIHHIQGQNPHAQGIALHLWGAFFLYDRIASTTMYRGKVFTEGNIAAMIVNKTVHKMIFSRQGQGYRHMNLTSTNKYWTSSNGTQTNDTGCFGTLQEYNSTKNQTCAPSKKPLPLPTAHPEVKLTSTSTDATKLNTTDPNSDDEDLTTSGSGSGEQEPYTTSDAATKQGLSSTMPPTPSPQPSTPQQGGNNTNHSQGVVTEPGKTNTTAQPSMPPHNTTTISTNNTSKHNLSTPSVPIQNATNYNTQSTAPENEQTSAPSKTTLLPTENPTTAKSTNSTKSPTTTVPNTTNKYSTSPSPTPNSTAQHLVYFRRKRNILWREGDMFPFLDGLINAPIDFDPVPNTKTIFDESSSSGASAEEDQHASPNISLTLSYFPKVNENTAHSGENENDCDAELRIWSVQEDDLAAGLSWIPFFGPGIEGLYTAGLIKNQNNLVCRLRRLANQTAKSLELLLRVTTEERTFSLINRHAIDFLLARWGGTCKVLGPDCCIGIEDLSRNISEQIDQIKKDEQKEGTGWGLGGKWWTSDWGVLTNLGILLLLSIAVLIALSCICRIFTKYIG

SEQ ID NO: 756 - protein, 676 aa, unidentified
  REGION 1..676: note = Zaire ebolavirus (strain Eckron-76) (ZEBOV) (Zaire Ebola virus)
MGVTGILQLPRDRFKRTSFFLWVIILFQRTFSIPLGVIHNSTLQVNDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYTEGLMHNQNGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIPAGIGVTGVIIAVIALFCICKFVF

SEQ ID NO: 757 - protein, 677 aa, unidentified
  REGION 1..677: note = Reston ebolavirus (strain Reston-89) (REBOV) (Reston Ebola virus)
MGSGYQLLQLPRERFRKTSFLVWVIILFQRAISMPLGIVTNSTLKATEIDQLVCRDKLSSTSQLKSVGLNLEGNGIATDVPSATKRWGFRSGVPPKVVSYEAGEWAENCYNLEIKKSDGSECLPLPPDGVRGFPRCRYVHKVQGTGPCPGDLAFHKNGAFFLYDRLASTVIYRGTTFAEGVVAFLILSEPKKHFWKATPAHEPVNTTDDSTSYYMTLTLSYEMSNFGGNESNTLFKVDNHTYVQLDRPHTPQFLVQLNETLRRNNRLSNSTGRLTWTLDPKIEPDVGEWAFWETKKNFSQQLHGENLHFQILSTHTNNSSDQSPAGTVQGKISYHPPANNSELVPTDSPPVVSVLTAGRTEEMSTQGLTNGETITGFTANPMTTTIAPSPTMTSEVDNNVPSEQPNNTASIEDSPPSASNETIYHSEMDPIQGSNNSAQSPQTKTTPAPTTSPMTQDPQETANSSKPGTSPGSAAGPSQPGLTINTVSKVADSLSPTRKQKRSVRQNTANKCNPDLYYWTAVDEGAAVGLAWIPYFGPAAEGIYIEGVMHNQNGLICGLRQLANETTQALQLFLRATTELRTYSLLNRKAIDFLLQRWGGTCRILGPSCCIEPHDWTKNITDEINQIKHDFIDNPLPDHGDDLNLWTGWRQWIPAGIGIIGVIIAIIALLCICKILC

SEQ ID NO: 758 - protein, 676 aa, unidentified
  REGION 1..676: note = Tai Forest ebolavirus (strain Cote d'Ivoire-94) (TAFV) (Cote d'Ivoire Ebola virus)
MGASGILQLPRERFRKTSFFVWVIILFHKVFSIPLGVVHNNTLQVSDIDKFVCRDKLSSTSQLKSVGLNLEGNGVATDVPTATKRWGFRAGVPPKVVNYEAGEWAENCYNLAIKKVDGSECLPEAPEGVRDFPRCRYVHKVSGTGPCPGGLAFHKEGAFFLYDRLASTIIYRGTTFAEGVIAFLILPKARKDFFQSPPLHEPANMTTDPSSYYHTTTINYVVDNFGTNTTEFLFQVDHLTYVQLEARFTPQFLVLLNETIYSDNRRSNTTGKLIWKINPTVDTSMGEWAFWENKKNFTKTLSSEELSFVPVPETQNQVLDTTATVSPPISAHNHAGEDHKELVSEDSTPVVQMQNIKGKDTMPTTVTGVPTTTPSPFPINARNTDHTKSFIGLEGPQEDHSTTQPAKTTSQPTNSTESTTLNPTSEPSSRGTGPSSPTVPNTTESHAELGKTTPTTLPEQHTAASAIPRAVHPDELSGPGFLTNTIRGVTNLLTGSRRKRRDVTPNTQPKCNPNLHYWTALDEGAAIGLAWIPYFGPAAEGIYTEGIMENQNGLICGLRQLANETTQALQLFLRATTELRTFSILNRKAIDFLLQRWGGTCHILGPDCCIEPQDWTKNITDKIDQIIHDFVDNNLPNQNDGSNWWTGWKQWVPAGIGITGVIIAIIALLCICKFML

SEQ ID NO: 759 - protein, 681 aa, unidentified
  REGION 1..681: note = Lake Victoria marburgvirus (strain Ozolin-75) (MARV) (Marburg virus (strain South Africa/Ozolin/1975))
MRTTCLFISLILIQGIKTLPILEIASNDQPQNVDSVCSGTLQKTEDVHLMGFTLSGQKVADSPLEASKRWAFRTGVPPKNVEYTEGEEAKTCYNISVTDPSGKSLLLDPPTNVRDYPKCKTIHHIQGQNPHAQGIALHLWGAFFLYDRIASTTMYRGKVFTEGNIAAMIVNKTVHKMIFSRQGQGYRHMNLTSTNKYWTSSNGTQTNDTGCFGTLHEYNSTKNQTCAPSKTPPPPPTARPEIKPTSTPTDATRLNTTNPNSDDEDLTTSGSGSGEQELYTTSDAVTKQGLSSTMPPTPSPQPGTPQQGGNNTNHSQDATTELDNTNTTAQPPTPSHNTTTISTNNTSKHNLSTLSAPPQNTTNPNTQSMATENEKTSAPPKATLPPTENPTTEKSTNNTKSPTTMEPNTTNGHFTSPSSTPNSTTQHLIYFRRKRSILWREGDMFPFLDGLINAPIDFDPVPNTKTIFDESSSSGASTEEDQHASSNISLTLSYLPHTSGNTAYSGENENDCDAELRIWSVQEDDLAAGLSWIPFFGPGIEGLYTAGLIKNQNNLVCRLRRLANQTAKSLELLLRVTTEERTFSLINRHAIDFLLTRWGGTCKVLGPDCCIGIEDLSRNISEQIDQIKKDEQKEGTGWGLGGKWWTSDWGVLTNLGILLLLSIAVLIALSCICRIFTKYIG

SEQ ID NO: 760 - protein, 364 aa, unidentified
  REGION 1..364: note = Zaire ebolavirus (strain Mayinga-76) (ZEBOV) (Zaire Ebola virus)
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKTSLEKFAVKSCLSQLYQTEPKTSVVRVRRELLPTQGPTQQLKTTKSWLQKIPLQWFKCTVKEGKLQCRI

SEQ ID NO: 761 - protein, 681 aa, unidentified
  REGION 1..681: note = Lake Victoria marburgvirus (strain Popp-67) (MARV) (Marburg virus (strain West Germany/Popp/1967))
MKTTCLFISLILIQGIKTLPILEIASNNQPQNVDSVCSGTLQKTEDVHLMGFTLSGQKVADSPLEASKRWAFRTGVPPKNVEYTEGEEAKTCYNISVTDPSGKSLLLDPPTNIRDYPKCKTIHHIQGQNPHAQGIALHLWGAFFLYDRIASTTMYRGRVFTEGNIAAMIVNKTVHKMIFSRQGQGYRHMNLTSTNKYWTSNNGTQTNDTGCFGALQEYNSTKNQTCAPSKIPSPLPTARPEIKPTSTPTDATTLNTTDPNNDDEDLITSGSGSGEQEPYTTSDAVTKQGLSSTMPPTPSPQPSTPQQEGNNTDHSQGTVTEPNKTNTTAQPSMPPHNTTAISTNNTSKNNFSTLSVSLQNTTNYDTQSTATENEQTSAPSKTTLPPTGNLTTAKSTNNTKGPTTTAPNMTNGHLTSPSPTPNPTTQHLVYFRKKRSILWREGDMFPFLDGLINAPIDFDPVPNTKTIFDESSSSGASAEEDQHASPNISLTLSYFPNINENTAYSGENENDCDAELRIWSVQEDDLAAGLSWIPFFGPGIEGLYTAGLIKNQNNLVCRLRRLANQTAKSLELLLRVTTEERTFSLINRHAIDFLLTRWGGTCKVLGPDCCIGIEDLSRNISEQIDQIKKDEQKEGTGWGLGGKWWTSDWGVLTNLGILLLLSIAVLIALSCICRIFTKYIG

SEQ ID NO: 762 - protein, 676 aa, unidentified
  REGION 1..676: note = Sudan ebolavirus (strain Boniface-76) (SEBOV) (Sudan Ebola virus)
MEGLSLLQLPRDKFRKSSFFVWVIILFQKAFSMPLGVVTNSTLEVTEIDQLVCKDHLASTDQLKSVGLNLEGSGVSTDIPSATKRWGFRSGVPPQVVSYEAGEWAENCYNLEIKKPDGSECLPPPPDGVRGFPRCRYVHKAQGTGPCPGDYAFHKDGAFFLYDRLASTVIYRGVNFAEGVIAFLILAKPKETFLQSPPIREAANYTENTSSYYATSYLEYEIENFGAQHSTTLFKINNNTFVLLDRPHTPQFLFQLNDTIQLHQQLSNTTGKLIWTLDANINADIGEWAFWENKKNLSEQLRGEELSFETLSLNETEDDDATSSRTTKGRISDRATRKYSDLVPKDSPGMVSLHVPEGETTLPSQNSTEGRRVDVNTQETITETTATIIGTNGNNMQISTIGTGLSSSQILSSSPTMAPSPETQTSTTYTPKLPVMTTEESTTPPRNSPGSTTEAPTLTTPENITTAVKTVWPQESTSNGLITSTVTGILGSLGLRKRSRRQVNTRATGKCNPNLHYWTAQEQHNAAGIAWIPYFGPGAEGIYTEGLMHNQNALVCGLRQLANETTQALQLFLRATTELRTYTILNRKAIDFLLRRWGGTCRILGPDCCIEPHDWTKNITDKINQIIHDFIDNPLPNQDNDDNWWTGWRQWIPAGIGITGIIIAIIALLCVCKLLC

SEQ ID NO: 763 - protein, 367 aa, unidentified
  REGION 1..367: note = Reston ebolavirus (strain Reston-89) (REBOV) (Reston Ebola virus)
MGSGYQLLQLPRERFRKTSFLVWVIILFQRAISMPLGIVTNSTLKATEIDQLVCRDKLSSTSQLKSVGLNLEGNGIATDVPSATKRWGFRSGVPPKVVSYEAGEWAENCYNLEIKKSDGSECLPLPPDGVRGFPRCRYVHKVQGTGPCPGDLAFHKNGAFFLYDRLASTVIYRGTTFAEGVVAFLILSEPKKHFWKATPAHEPVNTTDDSTSYYMTLTLSYEMSNFGGNESNTLFKVDNHTYVQLDRPHTPQFLVQLNETLRRNNRLSNSTGRLTWTLDPKIEPDVGEWAFWETKKTFPNNFMEKTCISKFYQPTPTTPQIRARRELSKEKLATTHPPTTPSWFQRIPLQWFQCSLQDGQRKCRPKV

SEQ ID NO: 764 - protein, 319 aa, unidentified
  REGION 1..319: note = Sudan ebolavirus (strain Human/Uganda/Gulu/2000) (SEBOV) (Sudan Ebola virus)
MGGLSLLQLPRDKFRKSSFFVWVIILFQKAFSMPLGVVTNSTLEVTEIDQLVCKDHLASTDQLKSVGLNLEGSGVSTDIPSATKRWGFRSGVPPKVVSYEAGEWAENCYNLEIKKPDGSECLPPPPDGVRGFPRCRYVHKAQGTGPCPGDYAFHKDGAFFLYDRLASTVIYRGVNFAEGVIAFLILAKPKETFLQSPPIREAVNYTENTSSYYATSYLEYEIENFGAQHSTTLFKIDNNTFVRLDRPHTPQFLFQLNDTIHLHQQLSNTTGRLIWTLDANINADIGEWAFWENKKKSLRTTTWRRAVFRSFIAQRDRRR

SEQ ID NO: 765 - protein, 676 aa, unidentified
  REGION 1..676: note = Zaire ebolavirus (strain Gabon-94) (ZEBOV) (Zaire Ebola virus)
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETRYTSGKRSNTTGKLIWKVNPEIDTTIGEWAFWETKKNLTRKIRSEELSFTAVSNRAKNISGQSPARTSSDPGTNTTTEDHKIMASENSSAMVQVHSQGREAAVSHLTTLATISTSLRPPITKPGPDNSTHNTPVYKLDISEATQVEQHHRRTDNASTTSDTPPATTAAGPLKAENTNTSKGTDLLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIPAGIGVTGVIIAVIALFCICKFVF

SEQ ID NO: 766 - protein, 332 aa, unidentified
  REGION 1..332: note = Reston ebolavirus (strain Reston-89) (REBOV) (Reston Ebola virus)
MGSGYQLLQLPRERFRKTSFLVWVIILFQRAISMPLGIVTNSTLKATEIDQLVCRDKLSSTSQLKSVGLNLEGNGIATDVPSATKRWGFRSGVPPKVVSYEAGEWAENCYNLEIKKSDGSECLPLPPDGVRGFPRCRYVHKVQGTGPCPGDLAFHKNGAFFLYDRLASTVIYRGTTFAEGVVAFLILSEPKKHFWKATPAHEPVNTTDDSTSYYMTLTLSYEMSNFGGNESNTLFKVDNHTYVQLDRPHTPQFLVQLNETLRRNNRLSNSTGRLTWTLDPKIEPDVGEWAFWETKKKLFPTTSWRKLAFPNSINPHQQLLRSEPGGNCPRKN

SEQ ID NO: 767 - protein, 568 aa, unidentified
  REGION 1..568: note = Simian virus 41
MSGAEGNTNKRTFRAVFRTLIILITLTILALSAAILYEVTHTSNGSESNNQVFDPTDTLNAITGNIKSMIALLNQILYNAAIALPLKIDSTESVLLAAIKDLQFSNPASQNCSSGGNLLNDALYINGINQYLLSNSFAGTVGLGPLLNIPSFIPSATAPGGCTRIPSFSLTKTHWCYSHNVILAGCADSKASNQYLAMGIVEQSSADFPFFRTMRTLYLSDGINRKSCSIVAIPGGCALYCYVATKTEQEDYAATTPSELRLTFYYYNETLVERTLTIPNVTGNWATLNPAVGSGVYHLGYLAFPVYGGLIQNSAAWNSQFGSYFLPQNPAVQCSGSAEQQINTAKGSYVVNWFSGRLIQSAVLVCPLSDQLTDQCRVVLFNNSETMMGAEGRLYTIGGDLYYYQRSSSWWTASLLYKINTDFSQGLPPLIEAQWVPTYLVPRPGAQPCSAGNFCPANCITGVYADVWPMNNPFPAGSSGVNPNYLFGGAFLWADVARVNPTFYMASATQYKNTTGFPNSNQKAAYTSTTCFQNTGSKKIYCLFIIEMGSSLMGEFQIVPFLREVIIT

SEQ ID NO: 768 - protein, 616 aa, unidentified
  REGION 1..616: note = Newcastle disease virus (strain D26/76) (NDV)
MDRAVSQVALENDEREAKNTWRLVFRIAILLLTVVTLAISAAALAYSMEASTPSDLVGIPTAISRTEEKITSALGSNQDVVDRIYKQVALESPLALLNTESTIMNAITSLSYQINGAANSSGCGAPIHDPDYIGGIGKELIVDDASDVTSFYPSAFQEHLNFIPAPTTGSGCTRIPSFDMSATHYCYTHNVILSGCRDRSHSHQYLALGVLRTSATGRVFFSTLRSINLDDTQNRKSCSVSATPLGCDMLCSKVTETEEEDYNSAIPTSMVHGRLGFDGQYHEKDLDVTTLFEDWVANYPGVGGGSFIDNRVWFPVYGGLKPNSPSDTAQEGKYVIYKRYNDTCPDEQDYQIRMAKSSYKPGRFGGKRVQQAILSIKVSTSLGEDPVLTVPPNTVTLMGAEGRVLTVGTSHFFYQRGSSYFSPALLYPMTVSNKTATLHSPYTFNAFTRPGSVPCQASARCPNSCVTGVYTDPYPLVFYRNHTLRGVFGTMLDDEQARLNPVSAVFDSISRSRITRVSSSSTKAAYTTSTCFKVVKTNKTYCLSIAEISNTLFGEFRIVPLLVEILKDDGVREARSGRLSQLQEGWKDDIVSPIFCDAKNQTEYRRELESYAASWP

SEQ ID NO: 769 - protein, 645 aa, unidentified
  REGION 1..645: note = Xenotropic MuLV-related virus (isolate VP42) (XMRV)
MESPAFSKPLKDKINPWGPLIIMGILVRAGASVQRDSPHQVFNVTWKITNLMTGQTANATSLLGTMTDTFPKLYFDLCDLVGDNWDDPEPDIGDGCRSPGGRKRTRLYDFYVCPGHTVLTGCGGPREGYCGKWGCETTGQAYWKPSSSWDLISLKRGNTPKGQGPCFDSSVGSGSIQGATPGGRCNPLVLEFTDAGKRASWDAPKTWGLRLYRSTGADPVTLFSLTRQVLNVGPRVPIGPNPVITEQLPPSQPVQIMLPRPPRPPPSGAASMVPGAPPPSQQPGTGDRLLNLVEGAYQALNLTSPDKTQECWLCLVSGPPYYEGVAVLGTYSNHTSAPANCSVTSQHKLTLSEVTGQGLCIGAVPKTHQALCNTTQKTSDGSYYLASPAGTIWACSTGLTPCLSTTVLNLTTDYCVLVELWPKVTYHSPNYVYGQFEKKTKYKREPVSLTLALLLGGLTMGGIAAGVGTGTTALVATKQFEQLQAAIHTDLGALEKSVSALEKSLTSLSEVVLQNRRGLDLLFLKEGGLCAALKEECCFYADHTGVVRDSMAKLRERLNQRQKLFESGQGWFEGLFNRSPWFTTLISTIMGPLIVLLLILLFGPCILNRLVQFVKDRISVVQALVLTQQYHQLKSIDPEEVESRE

SEQ ID NO: 770 - protein, 645 aa, unidentified
  REGION 1..645: note = Xenotropic MuLV-related virus (isolate VP62) (XMRV)
MESPAFSKPLKDKINPWGPLIIMGILVRAGASVQRDSPHQVFNVTWKITNLMTGQTANATSLLGTMTDTFPKLYFDLCDLVGDNWDDPEPDIGDGCRSPGGRKRTRLYDFYVCPGHTVLTGCGGPREGYCGKWGCETTGQAYWKPSSSWDLISLKRGNTPKGQGPCFDSSVGSGSIQGATPGGRCNPLVLEFTDAGKRASWDAPKTWGLRLYRSTGADPVTLFSLTRQVLNVGPRVPIGPNPVITEQLPPSQPVQIMLPRTPRPPPSGAASMVPGAPPPSQQPGTGDRLLNLVEGAYLALNLTSPDKTQECWLCLVSGPPYYEGVAVLGTYSNHTSAPANCSVTSQHKLTLSEVTGQGLCIGAVPKTHQALCNTTQKTSDGSYYLASPAGTIWACSTGLTPCLSTTVLNLTTDYCVLVELWPKVTYHSPNYVYGQFEKKTKYKREPVSLTLALLLGGLTMGGIAAGVGTGTTALVATKQFEQLQAAIHTDLGALEKSVSALEKSLTSLSEVVLQNRRGLDLLFLKEGGLCAALKEECCFYADHTGVVRDSMAKLRERLNQRQKLFESGQGWFEGLFNRSPWFTTLISTIMGPLIVLLLILLFGPCILNRLVQFVKDRISVVQALVLTQQYHQLKSIDPEEVESRE

SEQ ID NO: 771 - protein, 885 aa, unidentified
  REGION 1..885: note = Simian immunodeficiency virus (isolate F236/smH4) (SIV-sm) (Simian immunodeficiency virus sooty mangabey monkey)
MGCLGNQLLIALLLVSVLEICCVQYVTVFYGVPAWKNATIPLFCATKNRDTWGTTQCLPDNDDYSELAINVTEAFDAWDNTVTEQAIEDVWNLFETSIKPCVKLTPLCIAMRCNKTETDRWGLTGNAGTTTTAITTTATPSVAENVINESNPCIKNNSCAGLEQEPMIGCKFNMTGLNRDKKKEYNETWYSRDLICEQSANESESKCYMHHCNTSVIQESCDKHYWDAIRFRYCAPPGYALLRCNDSNYLGFAPNCSKVVVSSCTRMMETQTSTWFGFNGTRAENRTYIYWHGKSNRTIISLNKYYNLTMRCRRPENKTVLPVTIMSGLVFHSQPINERPKQAWCWFEGSWKKAIQEVKETLVKHPRYTGTNDTRKINLTAPAGGDPEVTFMWTNCRGEFLYCKMNWFLNWVEDRDQKGGRWKQQNRKEQQKKNYVPCHIRQIINTWHKVGKNVYLPPREGDLTCNSTVTSLIAEIDWINSNETNITMSAEVAELYRLELGDYKLIEITPIGLAPTSVRRYTTTGASRNKRGVFVLGFLGFLATAGSAMGAASVTLSAQSRTLLAGIVQQQQQLLDVVKRQQELLRLTVWGTKNLQTRVTAIEKYLKDQAQLNSWGCAFRQVCHTTVPWPNETLVPNWNNMTWQEWERQVDFLEANITQLLEEAQIQQEKNMYELQKLNSWDIFGNWFDLTSWIRYIQYGVLIVLGVIGLRIVIYVVQMLARLRQGYRPVFSSPPAYVQQIPIHKGQEPPTKEGEEGDGGDRGGSRSWPWQIEYIHFLIRQLIRLLTWLFSSCRDWLLRSYQILQPVLQSLSTTLQRVREVIRIEIAYLQYGWRYFQEAVQAWWKLARETLASAWGDIWETLGRVGRGILAIPRRIRQGLELTLL

SEQ ID NO: 772 - protein, 881 aa, unidentified
  REGION 1..881: note = Simian immunodeficiency virus (isolate Mm251) (SIV-mac) (Simian immunodeficiency virus rhesus monkey)
  VARIANT 736: note = X is any naturally occurring amino acid
MGCLGNQLLIAILLLSVYGIYCTQYVTVFYGVPAWRNATIPLFCATKNRDTWGTTQCLPDNGDYSELALNVTESFDAWENTVTEQAIEDVWQLFETSIKPCVKLSPLCITMRCNKSETDRWGLTKSSTTITTAAPTSAPVSEKIDMVNETSSCIAQNNCTGLEQEQMISCKFTMTGLKRDKTKEYNETWYSTDLVCEQGNSTDNESRCYMNHCNTSVIQESCDKHYWDTIRFRYCAPPGYALLRCNDTNYSGFMPKCSKVVVSSCTRMMETQTSTWFGFNGTRAENRTYIYWHGRDNRTIISLNKYYNLTMKCRRPGNKTVLPVTIMSGLVFHSQPINDRPKQAWCWFGGKWKDAIKEVKQTIVKHPRYTGTNNTDKINLTAPGGGDPEVTFMWTNCRGEFLYCKMNWFLNWVEDRDVTTQRPKERHRRNYVPCHIRQIINTWHKVGKNVYLPPREGDLTCNSTVTSLIANIDWTDGNQTSITMSAEVAELYRLELGDYKLVEITPIGLAPTDVKRYTTGGTSRNKRGVFVLGFLGFLATAGSAMGAASLTLTAQSRTLLAGIVQQQQQLLDVVKRQQELLRLTVWGTKNLQTRVTAIEKYLKDQAQLNAWGCAFRQVCHTTVPWPNASLTPDWNNDTWQEWERKVDFLEENITALLEEAQIQQEKNMYELQKLNSWDVFGNWFDLASWIKYIQYGIYVVVGVILLRIVIYIVQMLAKLRQGYRPVFSSPPSYFQXTHTQQDPALPTREGKEGDGGEGGGNSSWPWQIEYIHFLIRQLIRLLTWLFSNCRTLLSRAYQILQPILQRLSATLRRVREVLRTELTYLQYGWSYFHEAVQAGWRSATETLAGAWRDLWETLRRGGRWILAIPRRIRQGLELTLL

SEQ ID NO: 773 - protein, 821 aa, unidentified
  REGION 1..821: note = Simian immunodeficiency virus (isolate GB1) (SIV-mnd) (Simian immunodeficiency virus mandrill)
MSTGNVYQELIRRYLVVVKKLYEGKYEVSRSFSYTMFSLLVGIIGKQYVTVFYGVPVWKEAKTHLICATDNSSLWVTTNCIPSLPDYDEVEIPDIKENFTGLIRENQIVYQAWHAMGSMLDTILKPCVKINPYCVKMQCQETENVSATTAKPITTPTTTSTVASSTEIYLDVDKNNTEEKVERNHVCRYNITGLCRDSKEEIVTNFRGDDVKCENNTCYMNHCNESVNTEDCQKGLLIRCILGCVPPGYVMLRYNEKLNNNKLCSNISAVQCTQHLVATVSSFFGFNGTMHKEGELIPIDDKYRGPEEFHQRKFVYKVPGKYGLKIECHRKGNRSVVSTPSATGLLFYHGLEPGKNLKKGMCTFKGRWGLALWSLAKELNKLNDSIKVNQTCKNFTSTGEENKQNTDKQKEFAKCIKTLKIDNYTTSGDRAAEMMMMTCQGEMFFCNVTRIMRAWNDPNEKKWYPYASCQIRQIVDDWMQVGRKIYLPPTSGFNNHIRCTHRVTEMYFEMQKIDSNETKMQIKFLPPSETSNQFVAYGAHYKLVKIMPIGIAPTDVKRHTLPEHHKEKRGAVILGILGLLSLAGSAMGSVSVALTVQSQSLVTGIVEQQKQLLKLIEQQSELLKLTIWGVKNLQTRLTSLENYIKDQALLSQWGCSWAQVCHTSVEWTNTSITPNWTSETWKEWETRTDYLQQNITEMLKQAYDREQRNTYELQKLGDLTSWASWFDFTWWVQYLKWGVFLVLGIIGLRILLALWNTISRFRQGYRPVFSQDCQQNLYRKRPDNGEEESNSLELGEHNSENLKEESLNRSLIEDLTSFARE

SEQ ID NO: 774 - protein, 882 aa, unidentified
  REGION 1..882: note = Simian immunodeficiency virus (isolate Mm142-83) (SIV-mac) (Simian immunodeficiency virus rhesus monkey)
  VARIANT 737: note = X is any naturally occurring amino acid
MGCLGNQLLIAILLLSVYGIYCIQYVTVFYGVPAWRNATIPLFCATKNRDTWGTTQCLPDNDDYSELALNVTESFDAWENTVTEQAIEDVWQLFETSIKPCVKLSPLCITMRCNKSETDKWGLTKSSTTTASTTTTTTAKSVETRDIVNETSPCVVHDNCTGLEQEPMISCKFNMTGLKRDKKKEYNETWYSADLVCEQGNSTGNESRCYMNHCNTSVIQECCDKDYWDAIRCRYCAPPGYALLRCNDTNYSGFMPNCSKVVVSSCTRMMETQTSTWFRFNGTRAENRTYIYWHGRDNRTIISLNKHYNLTMKCRRPGNKTVLPVTIMSALVFHSQPVNERPKQAWCRFGGNWKEAIKEVKQTIVKHPRYTGTNNTDKINLTAPRGGDPEVTFMWTNCRGEFLYCKMNWFLNWVEDRSLTTQKPKERHKRNYVPCHIRQIINTWHKVGKNVYLPPREGDLTCNSTVTSLIANINWTDGNQTSITMSAEVAELYRLELGDYKLVEITPIGLAPTNVKRYTTGGTSRNKRGVFVLGFLGFLATAGSAMGAASLTVTAQSRTLLAGIVQQQQQLLDVVKRQQELLRLTVWGTKNLQTRVSAIEKYLKDQAQLNAWGCAFRQVCHTTVPWPNASLTPDWNNETWQEWERKVDFLEANITALLEEAQIQQEKNMYELQKLNSWDVFGNWFDLTSWIKYIQYGIYIIVGVILLRIVIYIVQMLARLRQGYRPVFSSPPSYFQXTHTQQDPALPTKEGKKGDGGGSGGNSSWPWQIEYIHFLIRQLIRLLTWLFSNCRTLLSRAYQILQPIFQRLSATLRRIREVLRLELTYLQYGWSYFQEAVQAAQRSATETLAGAWGELWEALQRGGRWILAIPRRIRQGLELTLL

SEQ ID NO: 775 - protein, 880 aa, unidentified
  REGION 1..880: note = Simian immunodeficiency virus (isolate MB66) (SIV-cpz) (Chimpanzee immunodeficiency virus)
MKAMETQRNCRTLSLKEIILCTLVLGIIGIIKCEDNMWVTVYYGVPVWREADTTLFCASDAKAQNPEVHNVWASQACVSTNPNPEEIELTNVTEYFNAWENNMVEQMHEDIVNLWDQSVKPCVKLIPLCVTLNCSLFKCIKENGNTTNCTVQISTGNDSTANNITVGTIDMYNCSFNATTELRDRKKQVYSLFYRQDLEPLEGNKPPEGDKNALYRLYNCNTTAMTQACSKVSLEPIPIHYCAPAGFALLKCNDKNFTGIGQCKNVSTVHCTHGIRPVVSTQFLLNGTLEEKVTVLDRNVSNDMDTIIVKLNETVRLNCTRTGNNTIKGIPIGPSQIFYGIETVIGDTRQAFCQLNKTVWTNTFKKVRHALNETYKGYLGNETITFGPSTGGDLEVTNLHLICGGEFFYCNTSILFNTSIIFNETKDDNITIPCRIRQIVRLWQRVGRGIFLPPIRGTINCISNITGILFAQQKTDRMNKSAMFTPVGGEMRNNWRSELYKYKVVRIEPLGVAPTKAKRRTVHREKRAAVGLGALFLGFLGAAGSTMGAASLTLTVQARQLLSGIVQQQSNLLRAIEAQQHLLQLSVWGIKQLQARVLAVERYLKDQQLLGLWGCSGKLICTTSVPWNTTWTNKSYDDIWYNMTWMQWDKEVSNYTDVIYNLLEKAQTQQENNEKELLELDKWASLWNWFDITSWLWYIKIFIIIVGGLIGLRIVFALLSIVNRVRQGYSPLSFQTLIPARRDRDRPEEIEEGGGEPDNVRSIRLVSGFLALAWNDLRDLCLFLYHRLRDLLLIVLRTLELVGQTLLKGLRRGREALIHLRGILQYWGQELKTSAISLLDTTAIAVAEGTDRIIEIAQRFGRGILNIPRRIRQGLERALL

SEQ ID NO: 776 - protein, 835 aa, unidentified
  REGION 1..835: note = Simian immunodeficiency virus (isolate EK505) (SIV-cpz) (Chimpanzee immunodeficiency virus)
MKVTEMQKNWLICCLLIGLIKIIGSELWVTVYYGVPVWRDAETVLFCASDAKAHSTEAHNIWATQACVPTDPNPQEVLIPNVTERFDMWKNNMVDQMQEDIISLWEQSLKPCVKLTPLCVTLSCSSWRSVNNSVNQTNHVQMQNCSFNVTTELRDKKKQVYSLFYMGDIIPLDTNNSSGNNSQYRLINCNTTAVTQACPKISFEPIPIYYCAPPGFAIIKCNDQDFNGTGECNNVSTVQCTHGIKPVISTQLILNGSLATSNIVIRNNSKDTLLVQLNESIPINCTRPGNKTRGQVQIGPGMTFYNIENIIGDTRQAYCEVNRTWEQIWNTTKQIIINNRKNITFIPNPGGDLEVTNLMINCGGEFFYCNTSQLFTNQNGNTTGNITLQCRIRQIVNLWTRVGKGIYAPPIKGPINCLSNITGIILDYTKSGTEKYTIYPTGGDMTNLWRQELYKYKVVSIEPIGVAPGKAKRHTVTRQKRAAFGLGALFLGFLGAAGSTMGAASITLTVQARKLLSGIVQQQNNLLRAIEAQQHLLQLSVWGIKQLQARVLAIERYLRDQQILGLWGCSGKSVCYTNVPWNTTWSNNNSYDTIWGNMTWQNWDEQVRNYSGVIFGLLEQAQEQQSINEKSLLELDQWSSLWNWFDITKWLWYIKIFIMVVAGIVGIRIISIIMSMVARVRQGYSPLSLQTLIPTTRGPDRPERTEEDAGELDNGRSVRLVSGFLALAWEDFRNLLLFLYHRLTDCLSILRRTLELLRQNIHKGLQLLNELRIYLWGIIAYWGRELKISAINLLDTTAVAVAEGTDRIIELVQRIGRGILHIPRRIRQGLERALL

SEQ ID NO: 777 - protein, 855 aa, unidentified
  REGION 1..855: note = Feline immunodeficiency virus (strain UK2) (FIV)
MAEGFAVNRQWIGPEEAEELLDFDIATQMNEEGPLNPGINLFRVPGITETEKQEYCNILQPKLQDLRNEIQEVKLEEGNAGKFRRARFLRYSDETILSLIHLFIGYCTYLCKRNKLGTLVHNIDIEAPQEECYSNRERGTTVNIKYSRRCCIGTTALYLLLLTGIIIYTQTTQAQVVWRLPPLVVPVEESEIIFWDCWAPEEPACQDFLGAMIYLKASTNISIQEGPTLGNWAREIWGTLFKKATRQCRRGRIWRRWNETITGPSGCANNTCYNISVIVPDYQCYLDRVDTWLQGKVNISLCLTGGKMLYNKDTKQLSYCTDPLQIPLINYTFGPNQTCMWNTSQIQDSDIPKCGWWNQIAYYNSCRWEQTDVKFHCQRTQSQPGTWLRTISSWKQKNRWEWRPDFESEKVRVSLQCNTTKNLTFAMRSSGDYGEVTGAWIEFGCHRNKSKLHSDARFRIRCRWNVGDNTSLIDTCGNDPNVSGANPVDCTMYANRMYNCSLQNGFTMKVDDLIMHFNMTKAVEMYNIAGNWSCTSDLPSTWGYMNCNCTNSSSTDSNKMACPKRQGILRNWYNPVAGLRQSLEKYQVVKQPDYLVVPREVMEYKPRRKRAAIHVMLALATVLSMAGAGTGATAIGMVTQYHQVLATHQETIEKITEALKVNNLRLVTLEHQVLVIGLKVEAIEKFLYTAFAMQELGCNQNQFFCKVPPELWQRYNMTINQTIWNHGNITLGEWYNQTKDLQQKFYEIIMDMEQNNVQGRKGLQQLQEWEDWVGWLGNIPRYLKGLLGGILGIGLGVLLLILCLPTLVDCIRNCISKVLGYTVIAMPEVEEEEIQPPMELRRNGRQCDMSEKEEE

SEQ ID NO: 778 - protein, 854 aa, unidentified
  REGION 1..854: note = Feline immunodeficiency virus (strain San Diego) (FIV)
MAEGFAANRQWIGPEEAEELLDFDKATQMNEEGPLNPGVNPFRVPAVTEADKQEYCKILQPRLQEIRNEIQEVKLEEGNAGKFRRARFLRYSDESILSLIHLFIGYCTYLVNRRRLGSLRHDINIEAPQEEQYSSREQGTTENIKYGRRCLIGTASLYLLLFIGVAIYLGTTNAQIVWRLPPLVVPVEESEIIFWDCWAPEEPACQDFLGAMIHLKASTNISIQEGPTLGNWAREIWGTLFKKATRHCRRNKIWKRWNETITGPVGCANNTCYNISVIIPDYQCYLDRVDTWLQGKVNISLCLTGGKMLYNRDTKQLSYCTDPLQIPLINYTFGPNQTCMWNTSQIQDPEIPKCGWWNQIAYYNSCRWESTNVKFYCQRTQSQPGTWIRTISSWRQKNRWEWRPDFESEKVKISLQCNSTHNLTFAMRSSGDYGEVMGAWIEFGCHRNKSRFHTEARFRIRCRWNVGDNTSLIDTCGKNLNVSGANPVDCTMYANKMYNCSLQNGFTMKVDDLIMHFNMTKAVEMYNIAGNWSCKSDLPQNWGYMNCNCTNGTSNDNKMACPEDKGILRNWYNPVAGLRQALEKYQVVKQPEYIVVPTEVMTYKYKQKRAAIHIMLALATVLSIAGAGTGATAIGMVTQYQQVLATHQEALDKITEALKINNLRLVTLEHQMLVIGLKVEAIEKFLYTAFAMQELGCNQNQFFCEIPKELWLRYNMTLNQTIWNHGNITLGEWYNQTKYLQQKFYEIIMDIEQNNVQGKQGLQKLQNWQDWMGWIGKIPQYLKGLLGGILGIGLGILLLILCLPTLVDCIRNCISKVLGYTVIAMPEIDDEEETVQMELRKNGRQCGMSEKEEE

SEQ ID NO: 779 - protein, 854 aa, unidentified
  REGION 1..854: note = Feline immunodeficiency virus (isolate Wo) (FIV)
MAEGFAANRQWIGPEEAEELLDFDIAIQMNEEGPLNPGVNPFRVPGITEAEKQEYCNILQPKLQDLKGKIQEVKLEEGNAGKFRRARFLRYSDETVLSLIHLFIGYCPHLCRRHELGSLRHDIDIEALQEERYNDREKGITDNIKYGKRCLIGTAVLYLLLSLGIIIHTCKAQVVWRLPPLVVPVEESEIIFWDCWAPEEPACQDFLGAMIHLKASTNISIQEGPTLGNWAREIWGTLFKKATRQCRRGRIWRRWNETITGPLGCANNTCYNISVIVPDYQCYLDRVDTWLQGKVNISLCLTGGKMLYNKETKQLSYCTDPLQIPLINYTFGPNQTCMWNTSQIQDPEIPKCGWWNQNAYYNSCRWEHTDVQFQCQRTQSQPGSWIRAISSWKQRNRWEWRPDFESEKVKVSLQCNSTKNLTFAMRSSGDYGEVTGAWIEFGCHRTKSKYHTEARFRIRCRWNVGDNTSLIDTCGETQNVSRANPVDCTMYANRMYNCSLQNGFTMKVDDLIMHFNKTKAVEMYNIAGNWSCKSDLPPTWGYMNCNCTNSTNSGTGIRMACPRNQGILRNWYNPVAGLRQSLEKYQVVKQPDYLVVPGEVMEYKPRRKRAAIHVMLALATVLSMAGAGTGATAIGMVTQYQQVLATHQEAIEKVTEALKINNLRLVTLEHQVLVIGLKVEAMEKFLYTAFAMQELGCNQNQFFCKVPSALWERYNMTINQTIWNHGNITLGEWYNQTKDLQQRFYEIIMDIEQNNVQGKKGLQQLQEWEDWVGWIGNIPQYLKGLLGGILGIGLGMLLLILCLPTLVDCIRNCIHKILGYTVIAMPEVEEEEIQPQMELRRNGRQCGMSEKEEE

SEQ ID NO: 780 - protein, 856 aa, unidentified
  REGION 1..856: note = Feline immunodeficiency virus (isolate Petaluma) (FIV)
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 781 - protein, 855 aa, unidentified
  REGION 1..855: note = Feline immunodeficiency virus (strain UK8) (FIV)
MAEGFAANRQWIGPEEAEELLDFDIATQMNEEGPLNPGINPFRVPGITETEKQDYCNMLQPKLQALRNEIQEVKLEEGNAGKFRRARFLRYSDETILSLIHLFIGYCTYLLNRKELGSLRHDIDIEAPQEECYSSREQSITDNIKYGKRCFIGTAGLYLLLFIGVGIYLGTAKAQVVWRLPPLVVPVEESEIIFWDCWAPEEPACQDFLGAMIHLKASTNISIQEGPTLGNWAKEIWGTLFKKATRQCRRGRIWKRWNETITGPLGCANNTCYNISVIVPDYQCYLDRVDTWLQGKVNVSLCLTGGKILYNKYTKQLSYCTDPLQIPLISYTFGPNQTCMWDTSQIQDPEIPKCGWWNQIAYYNSCRWESTDVKFHCQRTQSQPGLWLRAISSWKQRNRWEWRPDFESEKAKVSLQCNSTKNLTFAMRSSGDYGEVTGAWIEFGCHRNKSKLHTEARFRIRCRWNVGDNTSLIDTCGETQNVSGANPVDCTMYANRMYNCSLQNGFTMKVDDLIMHFNMTKAVEMYDIAGNWSCTSDLPPTWGYMNCNCTNSSSTNSVKMACPKNQGILRNWYNPVAGLRQSLEKYQVVKQPDYLVVPGEVMEYKPRRKRAAIHVMLALATVLSMAGAGTGATAIGMVTQYHQVLATHQETIEKVTEALKINNLRLVTLEHQVLVIGLKVEAMEKFLYTAFAMQELGCNQNQFFCKVPPELWKRYNMTINQTIWNHGNITLGEWYNQTKELQQKFYEIIMNIEQNNVQVKKGLQQLQEWEDWVGWIGNIPQYLKGLLGGILGIGIGVLLLILCLPTLVDCIRNCISKVLGYTVIAMPEIGDEEETVQMELRKNGRQCGMSEKEEE

SEQ ID NO: 782 - protein, 856 aa, unidentified
  REGION 1..856: note = Feline immunodeficiency virus (strain UT-113) (FIV)
MAEGFVANGQWIGPEEAEELVDFEIATQMNEEGPLNPGINPFRVPGITKQEKQEYCSTMQPKLQALRNEIQEVKLEEGNAGKFRRARFLRYSDETILSLIYLFIGYFRYLVDRKRFGSLRHDIDIEAPQEECYNNKEKGMTENIKYGKRCLVGTAALYLILAIGIIIIIRTTDAQVVWRLPPLVVPVEESEIIFWDCWAPEEPACQDFLGAMIHLKASTNISNTEGPTLGNWAREIWATLFKKATRQCRRGRIWKRWNETITGPIGCANNTCYNISVIVPDYQCYIDRVDTWLQGKVNISLCLTGGKMLYNKETKQLSYCTDPLQIPLINYTFGPNQTCMWNISQIQDPEIPKCGWWNQQAYYNNCKWERTDVKFQCQRTQSQPGSWIRAISSWKQGNRWEWRPDFESERVKVSLQCNSTRNLTFAMRSSGDYGEITGAWIEFGCHRNKSIRHNAARFRIRCRWNEGDNNSLIDTCGETQNVSGANPVDCTMYANKMYNCSLQDGFTMKVDDLIMHFNMTKAVEMYNIAGNWSCMSDLPTEWGYMNCNCTNDTSNNNTRKMKCPKENGILRNWYNPVAGLRQSLEKYQVVKQPDYLLVPEEVMEYKPRRKRAAIHVMLALATVLSMAGAGTGATAIGMVTQYHQVLATQQEAIEKVTEALKITNLRLVTLEHQVLVIGLKVEAMEKFLYTAFAMQELGCNQNQFFCKVPPELWRRYNMTINQTIWNHGNITLGEWYNQTKDLQKKFYGIIMDIEQNNVQGKKGLQQLQKWEDWVGWIGNIPQYLKGLLGSIVGIGLGILLLILCLPTLVDCIRNCIHKILGYTVIAMPEVDGEEIQPQMELRRNGRQCGMSEKEEE

SEQ ID NO: 783 - protein, 575 aa, Mayoro Virus
EGRAHGWPHEIIEYYYGLHPTTTIVVVVAVSVVVLLSVAASVYMCVVARNKCLTPYALTPGAVVPVTIGVLCCAPKAHAASFAEGMAYLWDNNQSMFWMELTGPLALLILTTCCARSLLSCCKGSFLVAVSVGSAVASAYEHTAVIPNQVGFPYKAHVAREGYSPLTLQMQVVETSLEPTLNLEYITCDYKTKVPSPYVKCCGTAECRTQDKPEYKCAVFTGVYPFMWGGAYCFCDSENTQMSEAYVERADVCKHDYAAAYRAHTASLRAKIKVTYGTVNQTVEAYVNGDHAVTLAGTKFIFGPVSTAWTPFDTKIVVYKGEVYNQDFPPYGAGQPGRFGDIQSRTLDSKDLYANTGLKLARPAAGNIHVPYTQTPSGFKTWQKDRDSPLNAKAPFGCTIQTNPVRAMNCAVGNIPVSMDIADSAFTRLTDAPIISELLCTVSTCTHSSDFGGVAVLSYKVEKAGRCDVHSHSNVAVLQEVSIEAEGRSVIHFSTASAAPSFIVSVCSSRATCTAKCEPPKDHVVTYPANHNGITLPDLSSTAMTWAQHLAGGVGLLIALAVLILVIVTCITLRR

SEQ ID NO: 784 - protein, 1239 aa, Barmah Forest Virus
MDFIPTQTFYGRRWRPAPVQRYIPQPQPPAPPRRRRGPSQLQQLVAALGALALQPKQKQKRAQKKPKKTPPPKPKKTQKPKKPTQKKKSKPGKRMRNCMKIENDCIFPVMLDGKVNGYACLVGDKVMKPAHVKGTIDNPELAKLTFKKSSKYDLECAQVPVCMKSDASKFTHEKPEGHYNWHHGAVQFSNGRFTIPTGSGKPGDSGRPIFDNTGKVVAIVLGGANEGARTALSVVTWNKDMVTRITPEESVEWSAAALNITALCVLQNLSFPCDAPPCAPCCYEKDPAGTLRLLSDHYYHPKYYELLDSTMHCPQGRRPKRSVAHFEAYKATRPYIGWCADCGLAGSCPSPVSIEHVWSDADDGVLKIQVSMQIGIAKSNTINHAKIRYMGANGVQEAERSTLSVSTTAPCDILATMGHFILARCRPGSQVEVSLSTDPKLLCRTPFSHKPRFIGNEKSPAPTGHKTRIPCKTYSHQTDLTREEITMHVPPDVPIQGLVSNTGKSYSLDPKTKTIKYKCTCGETVKEGTATNKITLFNCDTAPKCITYAVDNTVWQYNSQYVPRSEVTEVKGKIHVPFPLTDSTCAVSVAPEPQVTYRLGEVEFHFHPMYPTLFSIRSLGKDPSHSQEWIDTPMSKTIQVGAEGVEYVWGNNNPVRLWAQKSSSSSAHGNPISIVSHYYDLYPYWTITVLASLGLLIVISSGFSCFLCSVARTKCLTPYQLAPGAQLPTFIALLCCAKSARADTLDDFSYLWTNNQAMFWLQLASPVAAFLCLSYCCRNLACCMKIFLGISGLCVIATQAYEHSTTMPNQVGIPFKALIERPGYAGLPLSLVVIKSELVPSLVQDYITCNYKTVVPSPYIKCCGGAECSHKNEADYKCSVFTGVYPFMWGGAYCFCDTENSQMSEVYVTRGESCEADHAIAYQVHTASLKAQVMISIGELNQTVDVFVNGDSPARIQQSKFILGPISSAWSPFDHKVIVYRDEVYNEDYAPYGSGQAGRFGDIQSRTVNSTDVYANTNLKLKRPASGNVHVPYTQTPSGFSYWKKEKGVPLNRNAPFGCIIKVNPVRAENCVYGNIPISMDIADAHFTRIDESPSVSLKACEVQSCTYSSDFGGVASISYTSNKVGKCAIHSHSNSATMKDSVQDVQESGALSLFFATSSVEPNFVVQVCNARITCHGKCEPPKDHIVPYAAKHNDAEFPSISTTAWQWLAHTTSGPLTILVVAIIVVVVVSIVVCARH

SEQ ID NO: 785 - protein, 675 aa, Aura virus
SRATAMCNVTCDRTCYNRNDTTMTNVNHSYDVDAARCTRRHVRSTTDDTTAYGCHRCKTMCYSKKVWDDADDGVRVSAGYNRAGTAASARRMGGGVGAADKVTSKCHSHKGYVVKCGDSTTSKVHGSDTCTMRVGYKVGRKYTMHGTCTYRTRKSAGYVTMHRGSTMMSGGVYVTSGRNVTYCKCGDKTGTVTARTKDGCTRKCASADHVKWVNSDRHTDHTAGKHACTVAHGVKHAYRSMSTHAHTTTRHGNTAWVGSVTRNSTGYTWGNKVRVYASAGNHGWHVRHYYHYYTVTVSGMGACAGVSCCCKARRDCTYANATVVTCCCRTSADTDTMGYWHSTMWVAAVTVRCCSCCVASNKADAYHTTVNANSYKAVRGYANVMVMNTSVKRYTCRYHTVVSKCCGTVCKGKADYTCKVTGVYWGGACCDSNSSDKYVSTDCATDHAAVRVHTASVKSRTYGNSTAVDVVNGVTARSKDMKAGSTTSDNKVYHGKVYNYDGAGTGAGDVASSTTGSDANTAHRARNHVYTASGWKNNSGSDTAGCKVNVNRADKCAVGSSVDDAATRVSSKCTVTSCTYSTDYGGVVTYSDRAGCAVHSHSSTAVRDSVYVKGTTKSTRSADVSMCGTRTTCHACTHVMNRKSTDSSASKTSWNWTAMGGSSAAAAVVAVTAHR

SEQ ID NO: 786 - protein, 252 aa, Bebaru Virus
GAYCCDANSSAYVVRSMCKDHAVAYRAHTASKAKVRVSGSVNTVTVNGSKAKVSGSMGVSTAWTDNKVVYKDVNDYGSGGRGDSRTTTSKDYANTAKARSAGTHVYTTSGRYWKKGSANSKAGCKTGVRAMNCAVGNVSDDAVTRTDSATTCTVASCTHSSDGGVASAKTDKAGKCAVHSHSNVATVADVDVTTGKVAHSTASASSTVSCAARANCRASCKDHVYAAKHNNVVDVSGTAGWVKVAGGTGAVA

SEQ ID NO: 787 - protein, 712 aa, Middleburg virus
TAVTTACSNTDCSCACCYKDAGTRMDNVDNGYYDAASTHCDARRRRRGTDYKAYKTKYAYCSDCGNGCYSARVRAASDGMKSAGVDGAHSWTKRYMKGHDVDTDRNSVTTGCTVHGTMGHVATCGDSTVAVDKHKVRHACRAYKHRVVGRHTVRHHGVCTTYAMRTSVTTMHVAHDVDNTSKTGNKVKTKGKSRYNCTCGSKSGVTKDKDNCVSCHTMVTAHDKWNSYVRAGSGKKGKHVSNSTCRVANTAKNGTHVATTYRTGKHHTWSSCRTVGYTWGNHAVRWATTKGSAHGMHSYYYGYATTVAVCVGACVASASCCCVSARNKCTYATGAVVCTSCCARAKAATATAAYWANTVWMAVACMVTYCRHMCCRTASVAVSGMGATAYHSVTNAVGYRAHVDRGSTHMVVSTSTADYVTCYKTVVSKVTCCGMSCAHKADCKVYTGVYWGGAYCCDSNTSAYVRSVCKHDHAAAYRAHTAAKAKSVTYGSTNGTAAVNGSTARGDKMGSTAWSDKVVYKDVYNDYYGSGGRGDSRTTSNDVYANTAKARSAGTVHVYTTSGKYWKKGDANHKAGCKTNVRANCAVGNVSDDAATRVDASTGKCVATCTHSSDGGTVVYKTDKVGTCAVHSSNTAVMTSSVTMDGRGTHSTASASSVKVCSSKTTCTAKCVKDHVVANHNNVVDSSTAVSWTHTMGGATVVAGTVTCASRH

SEQ ID NO: 788 - protein, 271 aa, unidentified
  REGION 1..271: note = Mucambo virus
LVTTMCLLANVTFPCSTPPICYDRAPAETLMMLSKNIDNPGYDELLEAVLKCPGRQKRSTEELFKEYKLTRPYMAKCVRCAVGSCHSPIAIEAVRSDGHDGYIRIQTSSQYGLDPSGNVKSRVMRYNLYGKIVEVPLHQVSLHTSRPCHIIDGHGYFLLARCPEGDSITMEFKKDSVTHSCSVPYEVKFTPVGRELYSHPPEHGTEHPCRVYAHDAQQKDAYVEMHLPGSEVDSSLLSMSGSAVRVTPPSGQSVLVECNCGSAVSETINTA

SEQ ID NO: 789 - protein, 343 aa, Ndumu Virus
GAYCFCSSENTQMSEAYVERAEVCKHEHALAYKTQTASLTATLKVTLGNITQGAKAYVNGETPFQIGQAKFVLGPISAAWSPFNPKIVVYKDDVYNYDFPAYGAGQPGRFGDIQSRTVDSKDLYARTHLRLDRPASGNIHVPYTQIPSEFKYWMQEKGEPLNRQAAFGCVVKTNPVRADNCAYGNIPISVDIPDAMFTRVVDIPAVSHLQCIDVSCAHSAGFGGVAKLRFMADRTGKCAIHTASKIVAIQEATVDLPEIAVGAGGGTAEITFHYSTALASPSFDVQLCSAHVTCDTKCEPPKDHIVPFAAQHMSNDMPNLSATAMNWVTGLGTSIGTFVFLFL

SEQ ID NO: 790 - protein, 987 aa, O'nyong-nyong virus
SLALPVMCLLANTTFPCSQPPCAPCCYEKKPEETLRMLEDNVMQPGYYQLLDSALACSQHRQRRNARENFNVYKVTRPYLAHCPDCGEGHSCHSPIALERIRSEATDGTLKIQVSLQIGIKTADSHDWTKLRYMDSHTPVDADRSGLFVRTSAPCTITGTMGHFILARCPKGETLTVGFVDSRRISHTCMHPFHHEPPLIGREKFHSRPQHGKELPCSTYVHTTAATTEEIEVHMPPDTPDYTLMTQQAGNVKITVDGQTVRYKCKCDGSNEGLITTDKVINNCKVDQCHTAVTNHKKWQYNSPLTPRNSEQGDRKGKIHIPFPLVNTTCRVPKARNPTVTYGKNRVTLLLYPDHPTLLSYRAMGRIPDYHEEWITSKKEISITVPAEGLEVTWGNNDPYKYWPQLSTNGTAHGHPHEIILYYYELYPTTTIAVLAAASIVVASLVGLSLGMCICARRRCITPYELTPGATIPFLLGILCCVKTAKAASYYEAATYLWNEQQPLFWLQLLIPLSAAIVVCNCLKLLPCCCKTLTFLAVMSIGARTVSAYEHATVIPNTVGVPYKTLVSRPGYSPMVLEMELQSVTLEPTLFLDYITCEYKTITPSPYVKCCGTAECKAKNLPDYNCKVFTGVYPFMWGGAYCFCDAENTQLSEAHVEKSESCKTEFASAYRAHTASVSAKLRVFYQGNNITVSAYANGDHAVTVKDAKFVIGPLSSAWSPFDNKIVVYKGEVYNMDYPPFGAGRPGQFGDIQSRTPDSKDVYANTQLILQRPAAGAIHVPYSQAPSGFKYWLKEKGASLQHTAPFGCQIATNPVRAVNCAVGNIPVSIDIPDAAFTRVTDAPSVTDMSCEVASCTHSSDFGGAAVIKYTASKKGKCAVHSLTNAVTIREPNVDVEGTAQLQIAFSTALASAEFKVQICSTQVHCSATCHPPKDHIVNYPSPHTTLGVQDISTTAMSWVQKITGGVGLVVAIAALILIIVLCVSFSRH

SEQ ID NO: 791 - protein, 265 aa, unidentified
  REGION 1..265: note = Pixuna virus
LVTTMCLLANVSFPCSQPPMCYDHKPAATLALLSANVDRPGYDDLLEAVLKCPGRARRSTDELFKEYKLTRPYMAKCIRCAVGSCHSPIAIEAVRSDGHDGYVRIQTSSQYGLDPSGSVKRRTMRYNMHGKIEEVPLHEVSLHTSRPCHIVDGHGYFLLARCPPGDSITMEFKKEHVTHLCSVPYEVRFTPVGRELYTHPPEHGAEHPCRVYAHDAQHHGAYVEMHLPGLEVDSTMLSLSGGAVQITPPTGKTAFVECKCGAQIS

SEQ ID NO: 792 - protein, 335 aa, unidentified
  REGION 1..335: note = Tonate Virus
GAYCFCDSENTQLSRAYVTKSDDCSADHALAYKAHTASVQAFLNITVGEQSTTAVVYVNGETPISFNGIRLVAGPLSTAWTPFDRKVVQYAGEIYNYDFPEYGAGHAGAFGDLQARTTTSNDLYANTNLVLQRPTAGTIHVPYTQAPSGFEQWKKDKPPSLKYTAPFGCEIYVNPVRAENCAVGSIPLAFDIPDALFTRVSETPTLSNAECSLNECVYSSDFGGIATVKYTASKSGKCAVHIPSGTATLKESLVDVVEQGSLTLHFSTANIHPEFKLQICTTHLTCKGDCHPPKDHIVTHPQLHAQTFTAAVSKTAWTWLTSLLGGSAVIIIIGL

SEQ ID NO: 793 - protein, 335 aa, unidentified
  REGION 1..335: note = Trocara virus
  VARIANT 278: note = X is any naturally occurring amino acid
GAQCFCESENTQMSEAYVDRSPDCKTLNAKAYRAHTANFKAKLNITFGDKYEVVEAFANGVTKVNAGQLTAVLGPMASPWSPFDNKIVLYKDKVYNYDFPEYGAGLPGAFGDIQMMSPTSADLYARTNLKLLRPNSGQIHVPYTQAPSGFVHWTNNSGKSLQDTAPFGCNIKTNPIRAENCAVGSIPVSLDIPDAEFTRVSEAPHITSASCTVTSCTSSTEAGGVMHIEYKAAKPGKCAVQALSSVVTITESNADIQTEGTLELHFSTAAIQADFRVXVCASGVQCTGPCRPPKEHIVAKPQLTTKEFKNAISSTSWNWVYALLGSTSSLLLVGV

SEQ ID NO: 794 - protein, 334 aa, Whataroa virus
GAQCFCDTENTQMSEAYVERSSDCAVDHAQALKVHTSSMKVGLKITYGNTTGMLDVFVNGVTPGTSKDLKVIAGPISAAFSPFDSKVVVYKGMVYNYDFPEFGAMKPGVFGDIQASSPTSNDLVANTDIRLLRPIARNVHVPYTQAASGFEMWKNNSGRPLQETAPFGCKVQTNPLRASDCAYGNIPISLDIPNAAFMRISDAPLISAATCTVSECIYSADYGGMASIQYTSDREGQCPVHSHSSTASLQESTVHVVQSGTVTVHFSTASPQANFVISLCGKKTICHAECKPPADHIVKTPHKNDQEFRSAVSTTSWSWLFALFGGASSLIFIG

SEQ ID NO: 795 - protein, 668 aa, unidentified
  REGION 1..668: note = Bussuquara virus
FKVVTGPEGPIMDVTKKDVGKALEIPFQNFNNTCWVMAMDVGHPCEDTIEYECPSLDIGAEPNDIDCWCDTMPMRVRYGRCTKGSIPKRSRRNAVFPQHTENVLATRQETWMNTDVIMKHLIKVETWALRNPGFALVAITLGWMLGSNRSQKIIFTILLLLVAPAYNMRCIGVENRDFVEGLSGGTWVDVVLEHGGCVTVRVEGKPTLDFELVQTKATGLAAVRAYCYQAKVSDIQISAACPAVQLTENSKATDSNYLCRRGVTNRGWNNGCGLFGKGDIHTCVKFKCEKKAAGFSIGKENLEYEVRASVHNSIGADKFSNELADGEPHTQKMKFSPLSPSAEKSFGDYGTLGMDCEPQSGLDFGQLYLMTIESKSWLVNRDWYHDLHLPYTVGSGSQWNNREALVEFQEPHATKQEVLALGSQEGALHSALAGAIMANRETSSPHALLLTAGHLKCRIKMDKMVIKGITYGQCSGTFKMEKHPADTGHGTVVLDVSYQGDDAPCKIPIVITSNLAEVEPVGRLVSAHPVITAKNVRTMLEVEPPYGDSYIVIGVGDGRLKQHWFKKGSVIGGAFSTTMKGAKRLAVLGDAAWDFGSVGGVFNSLGKAVHQLFGGIFRTLFGGMSWLSRLMIGALCLWIGINARDHSIAVTMLSVGGILIFLSINVSA

SEQ ID NO: 796 - protein, 271 aa, unidentified
  REGION 1..271: note = Jugra virus
FTSTGHMDVYEMDMTKVEYTIKTQVHSGAKSGDATLVKSIKFTPVSGTQTVEFSGYGTLGLECHVQSAIDFTTHYLVVIGSDAWLVHKQWVADVTLPWSHGDANVWRDKNYLVEFGEPHAATVKVLAMGPQEGALRTALAGAMVVSYDSGSKTFKLHGGHVTCKAMVNNLVLKGTTYQNCRGGLSFTKTPADTGHGTVVMQVKVTKNTPCRLTAIASDDASGRVNRGTLVTSNPVANSANDEVLIEINPPYGESYLIAGVGDDKLVYQWFQ

SEQ ID NO: 797 - DNA, 465 bp, Avian leukosis virus
  source 1..465: mol_type = genomic DNA
atggaagccgtgatcaaggtgatcagctccgcatgcaagacctactgtggcaagacgagcccaagcaagaaggaaatcggcgctatgctgagcctgctgcagaaggagggcctcctgatgagcctgtctgatctgtacagcccaggtagctgggaccctatcaccgccgccctgacacagagagccatggtgctgggcaaaagcggcgagctgaagacatggggactggtgctgggcgccctgaaagccgctagagaagagcaagtaaccagcgagcaggccaagttctggctgggactgggcggcggtagagtgagcccccctggccctgagtgcatcgagaagcctgccaccgagcggcgcattgacaaaggcgaagaagtgggcgagacaaccgtgcagagagacgccaagatggctccagaagagacagcaaccccaaagaccgtgggcaccagctgctac

SEQ ID NO: 798 - DNA, 252 bp, Avian leukosis virus
  source 1..252: mol_type = genomic DNA
cactgcggcaccgctatcggctgcaactgcgccaccgccagcgcgcctcctcccccgtatgtgggcagcggcctctacccctccctggcaggagtgggagagcagcagggccagggcggagatacacccagaggcgccgagcagcctagagccgaacccggccacgccggccaggcccctggccccgccctgaccgactgggccagaatcagagaggagctggcctctacaggccctccagtggtcgccatg

SEQ ID NO: 799 - DNA, 750 bp, Avian leukosis virus
  source 1..750: mol_type = genomic DNA
cctgtggtgatcaagaccgagggacctgcctggacccctctggaacctaaactgattacacggctggctgataccgtcagaaccaagggcctcagaagccccatcacaatggccgaagtggaagccctgatgagcagcccactgctgcctcacgacgtgaccaacctgatgcgggtgatcctgggccccgccccttacgccctgtggatggacgcctggggcgtgcagctgcaaacagttatcgccgccgccacaagagacccccggcacccagccaacggccagggcagaggcgagagaacaaacctggatcggctgaagggcctcgccgatggcatggccggcaatcctgagggccaggctgctctgctgagacccggggaactggttgctatcaccgccagcgccctgcaggccttcagagaagtggcccggctggccgagcctacagacccctgggccgagatcacccagggcccttctgagagcttcgtggacttcgccaacagactgatcaaggccgttgagggctccgacctgcctcctagcgcccgcgcccccgtgatcatcgactgttttagacagaaatcgcaacccgacatccagcagctgatccgggccgctccttctaccctgaccacacctggcgagatcatcaagtacgtgctggacagacagaagaccgcccccctgaccgacagaggaatcgccgccgccatgtctagcgccattcagcctctggtgatggcc

SEQ ID NO: 800 - DNA, 264 bp, Avian leukosis virus
  source 1..264: mol_type = genomic DNA
gtggtcaacagagaaagagatggacagacaggttctggcggcagagcccggggcctgtgctacacctgcggatcccctggacactaccaggcccagtgtcctaagaaaagaaagtctggtaacagcagagagcggtgccagctgtgtgatggcatgggccacaacgccaaacagtgccggagacgggacggaaaccaaggacaaagacccggccggggactgagcagcggaccttggcctgtcagccagcaacctgccgtgtcc

SEQ ID NO: 801 - DNA, 384 bp, Avian leukosis virus
  source 1..384: mol_type = genomic DNA
ctggctatgaccatggaacacaaggaccggcctctggtgcgggtgatcctgacaaataccggctctcaccccgtgaagcagcggtcagtgtacatcacagccctgctggacagcggcgctgatatcaccatcattagcgaggaggactggcctaccgactggcccgtgatggaagctgccaatccccagatccacggcatcggaggcggaatcccgatgagaaagtccagagacatgatcgaggtgggcgtgatcaaccgggacggctctcttgagagacctctgctgctgttccccgccgtggctatggtgcgaggcagcatcctgggccgcgactgcctgcagggcctgggcctgagactgaccaacctgaactttagccag

SEQ ID NO: 802 - DNA, 465 bp, Rous sarcoma virus
  source 1..465: mol_type = genomic DNA
atggaggccgtgatcaaggtgatcagcagcgcatgcaagacctactgcggcaagaccagcccatctaagaaagagatcggcgccatgctgagcctgctccaaaaggaaggcctgctgatgagcccttccgacctgtacagccccggaagctgggacccaatcaccgctgccctgacccagcgggccatggtgctgggaaagagcggcgagctgaagacctggggcctggtgctgggagccctgaaggccgccagagaggaacaagtgacaagcgaacaggccaagttctggctgggactgggcggaggaagagtcagccctcctggcccagagtgcatcgagaagcccgctacagagagaagaatcgataagggcgaagaggtgggcgagacaacagtgcagagagacgccaagatggctcctgaggaaaccgccacacctaagaccgtgggcacatcttgttac

SEQ ID NO: 803 - DNA, 252 bp, Rous sarcoma virus
  source 1..252: mol_type = genomic DNA
cactgcggcaccgccattggatgtaactgcgctacagccagcgcccccccccctccctacgtgggcagcggactttatcctagcctggccggcgtgggagagcagcagggccaaggcggagatacacccagaggcgccgagcagcctagagccgaacccggccacgccggactggcccctggcccagccctgaccgactgggcccgcatccgggaagaactggcttctaccggccccccggtggtcgccatg

SEQ ID NO: 804 - DNA, 747 bp, Rous sarcoma virus
  source 1..747: mol_type = genomic DNA
cctgtggttatcaagacagagggccctgcttggacccctctggaaccaaagctgattacaagactcgccgacaccgtgcggaccaagggcctgcggagccctatcaccatggccgagatggaagctctgatgagcagcccactgctgccccacgacgtgaccaacctgatgagagtgatcctgggccccgccccttacgccctgtggatggacgcctggggggtgcagctgcagaccgtgattgccgccgccaccagagatcctagacaccctgctaacggccaaggcagaggcgaaagaaccaaccttgacagactgaaaggcctggccgatggaatggtcggcaacagcgaaggccaggccgccctgctgagacctggcgagctggtggctatcacagccagcgccctgcaggccttcagagaagtggcccgactggctgagcccacggacccttgggccgacatcatgcagggcccttctgagagcttcgtggacttcgccaatagactgatcaaggccgtcgagggcagcgatcttcctcctagcgcgagagcccctgttatcatcgactgcttccggcagaaaagccagcccgacatccaacagctgatcagagccgccccttccaccctgaccacaccaggcgagatcatcaagtacgtgctggatagacagaagaccgcccctctgaccgatcagggcatcgccgctgccatgtcctctgccatccagcctctggtgatg

SEQ ID NO: 805 - DNA, 267 bp, Rous sarcoma virus
  source 1..267: mol_type = genomic DNA
gccgtggtgaacagagagagagacggccagacaggctccggcggccgggccagagagctgtgctacacctgtggctctccaggccactaccaggctcagtgtcctaaaaagcggaagtctggcaattctagagagcggtgccagctgtgcaacggcatgggccataatgccaaacagtgtcggaaacgggacggaaaccagggccagagaccaggcagaggcctgtcttctggcccctggcccggccctgagcctcctgctgtgtcc

SEQ ID NO: 806 - DNA, 393 bp, Rous sarcoma virus
  source 1..393: mol_type = genomic DNA
ctggctatgaccatggaacacaaggacagacccctggtgcgggtgatcctgacaaacaccggaagccaccccgtgaagcagcgctccgtgtacatcacagcccttctggacagcggcgccgacatcaccatcatcagcgaggaagattggcctacagactggcctgtgatggaagccgcaaacccccagatccacggcatcggcggaggtatacccatgcggaagagcagagacatgatcgagctgggcgtgatcaaccgggacggcagcctggaacggcccctgctgttgtttcctgctgtggctatggtgcggggaagcatcctgggcagagattgcctgcagggcctgggcctgcgcctgaccaacctgtgaggagggccactgttctca

SEQ ID NO: 807 - DNA, 270 bp, Ovine enzootic nasal tumor virus
  source 1..270: mol_type = genomic DNA
atgggccagacccacagcagacaactgttcgtgcacatgctgtccgtgatgctgaagcacagaggcatcaccgtgtctaagcctaagctgatcaacttcctgagcttcatcgaggaagtgtgtccttggtttccacgggaaggcacagtgaacctggaaacatggaaaaaggtgggcgaacagatcagaacccactacaccctgcacggccctgagaaggtgcctgtggaaacactttccttctggaccctgatccgcgactgcctggat

SEQ ID NO: 808 - DNA, 546 bp, Ovine enzootic nasal tumor virus
  source 1..546: mol_type = genomic DNA
ttcgacaatgacgagctgaaaagactgggcaacctgctcaagcaggaggaagatcctctgcacgaccctgacagcgagaacagctacgacgcccctcctcctcctcatcctagcctgcactctagcagaccttccgacaacgacgacctgctgtctagcacagacgaggccgagctggacgaggaagccgccaagtaccaccaggaggactggggcttcctggctcaggagaaaggcgccctgacaagcaaggacgagctggtggaatgtttcaagaacctgaccatcgccctgcagaacgctggaatcaagctgccagccaacaacgataagttcccctccgccccccctctgcctcctgcctacgcccctagcgtggtggccggactggatccaccccccggccccctgcccccaagcaagaacatgtctccactgcagaaagccctgagacaagcccagaggctgggcgaagttgtgtccgatttcagcctggccttccccgtgttcgagaacaacaaccagcggtactacgagagcctgcct

SEQ ID NO: 809 - DNA, 618 bp, Ovine enzootic nasal tumor virus
  source 1..618: mol_type = genomic DNA
ttcaagcagctgaaggaactcaaaatcgcatgcagccagtacggccctaccgcaccttttaccatcgccatgatcgagaacctcggcacccaggccctgccacctaatgattggaagcagacagccagagcctgcctgtcaggcggagattacctgctgtggaagagcgagttcttcgagcaatgcgccagaatcgctgacgtgaaccggcagcagggcatccagacgagctacgagatgctgatcggcgagggaccctaccaggccaccgacacccagctgaacttcctgcctggggcctatgcccaaatcagcaacgccgccagacaggcttggaagaaactgcctagctcttctacaaagaccgaggacctgagcaaagtgcggcaaggccccgatgagccctaccaggactttgtcgccagactgctcgacaccatcggcaagatcatgagcgacgaaaaggccggcatggtcctggctaagcaactggctttcgagaatgctaatagcgcctgtcaggccgccctgcggccttacagaaagaagggcgacctgtccgattttatcagaatctgcgccgacatcggcccctcttatatgcagggaattgccatg

SEQ ID NO: 810 - DNA, 405 bp, Ovine enzootic nasal tumor virus
  source 1..405: mol_type = genomic DNA
gccgctgctctgcagggcaaaagcatcaaggaagtgcttttccagcagcaagctcggaacaagcggggaagacagagaagcggcaatagcggttgttttgtgtgcggccagcccggccaccgcgccgccgtgtgcccccagaagcagcagagccccgtgaacacccctaatctgtgcccgcgctgtaaaaaaggaaagcattgggcacgagattgccggtccaaaacagatgttcaaggtacccctttacccccggtgtcgggaaactgggtgaggggccagcccctggccccgaaacaatgttatggggcaacactgcaggttccaaaagaaccattgcagacctctgtcgagccacaagaggcagcgcgggattggacctctgtgccacctcctacacagtat

SEQ ID NO: 811 - DNA, 999 bp, Ovine enzootic nasal tumor virus
  source 1..999: mol_type = genomic DNA
aaaaggaaagcattgggcacgagattgccggtccaaaacagatgttcaaggtacccctttacccccggtgtcgggaaactgggtgaggggccagcccctggccccgaaacaatgttatggggcaacactgcaggttccaaaagaaccattgcagacctctgtcgagccacaagaggcagcgcgggattggacctctgtgccacctcctacacagtattaactcccgagatgggggtccaaaccctggctacaggcgtgttcggtcctctgccccccggcaccgccggcctgctgctgggcagaagcagcgccagcctgaagggcatcctgatccatcctggagtgattgacagcgactacaccggcgagatcaagatcctggcctctgcccctaacaagatcatcgtgatcaacgccggccaaagaatcgcccagctgctgctcgtgcctctggtgatccagggcaaaaccatcaaccgggacaggcaggacaagggatttggatcttctgacgcctattgggtgcagaacgtgaccgaggccagacctgaactggaacttagaatcaatggcaagctgttccggggcgtgctggatacaggcgccgacatcagcgtgatcagcgacaaatactggcccaccacctggcctaagcagatggctatctctacactgcagggcatcggccagacaaccaaccccgagcagagcagcagcctgctgacctggaaggacaaggacggccacaccggccaattcaagccctacatcctgcctcacctgcctgtgaacctgtggggcagagatatcctgagcaagatgggcgtctacctgtactcccctagccctaccgtgacagatctgatgctggaccagggcctgctgcctaatcagggcctcggaaagcaacaccagggaattatcctgccactggacctgaaaagcaaccaggatagaaagggcctgggatgcttcccctgaggacctctgattctcctg

SEQ ID NO: 812 - DNA, 297 bp, Mouse mammary tumor virus
  source 1..297: mol_type = genomic DNA
atgggcgtgtccggctcaaagggccagaagctgtttgtgtccgtgctgcagcgtctgctgtccgaacggggcctacacgtgaaagagagcagcgccatcgagttctaccagtttctgatcaaggtgtcaccctggttccccgaggaaggcggcctgaatctgcaggattggaagagagtgggcagagaaatgaagaagtacgccgctgagcacggcaccgacagcatccccaagcaggcttatcctatctggctgcaactgagagagatcctgacagagcaatctgacctggtgctg

SEQ ID NO: 813 - DNA, 288 bp, Mouse mammary tumor virus
  source 1..288: mol_type = genomic DNA
ctgagcgccgaggccaagtccgtgacagaggaagaactggaagaaggcctgacaggactgctgagcgccagcagccaggagaagacctacggcacaagaggcaccgcctatgccgaaatcgacaccgaggtggataagctgagcgagcacatctacgacgagccctacgaggagaaggaaaaggccgacaagaacgaggagaaggaccacgtgcggaaggtcaagaagatcgtgcaaagaaaggaaaatagcgagcataagagaaaggagaaagatcagaaggccttc

SEQ ID NO: 814 - DNA, 222 bp, Mouse mammary tumor virus
  source 1..222: mol_type = genomic DNA
ctggcaaccgactggaacaacgacgacctgagccctgaggactgggacgacctggaagagcaggccgcccactaccacgatgacgacgaactgatcctgcctgtgaagagaaaggtggacaagaagaagccgctcgccctgaggcggaaacctctgcccccggttggcttcgccggagccatggccgaggctagagagaagggcgatctgaccttcacattt

SEQ ID NO: 815 - DNA, 681 bp, Mouse mammary tumor virus
  source 1..681: mol_type = genomic DNA
cccgtggttttcatgggagaatccgacgacgatgatacccctgtgtgggaacctctgcccctgaagacactgaaggaactgcagtctgccgtgcggaccatgggccctagcgccccttacaccctccaggtggtggacatggttgcctctcagtggctgacacctagcgattggcaccaaaccgccagagccaccctgtctcctggggactacgtgctgtggcggaccgagtacgaggagaagagcaaggaaaccgtgcagaagaccgctggcaagcggaaaggcaaggtgagcctggatatgctgctgggcacaggtcagttcctgagcccttcttctcagatcaagctttctaaagatgtgctgaaggatgtgaccaccaacgccgtcctggcctggagagccatccctcctccaggcgtcaaaaagacagtgctggccggactcaagcagggaaatgaggaaagctacgagacattcatcagcagactggaagaggccgtgtacagaatgatgcctagaggagaaggcagcgacatcctgatcaagcagctggcttgggagaacgctaattctctgtgccaggacctgatccggcctatgcggaagaccggcaccatgcaggactacatcagagcctgtctggatgcctcccctgccgtggtgcagggcatggcctac

SEQ ID NO: 816 - DNA, 723 bp, Mouse mammary tumor virus
  source 1..723: mol_type = genomic DNA
gccgccgcaatgagaggacaaaagtacagcaccttcgtgaaacagacatacggcggcggaaaaggcggacagggctctgaaggccctgtgtgcttcagctgcggcaaaacaggtcacattaagcgggattgcaaggaagagaaaggaagcaagcgcgctcctcctggactgtgtcctagatgcaagaaaggctaccactggaagagcgagtgcaagagcaagttcgacaaggacggcaaccctctgccaccactggaaactaacgccgaaaacagcaaaaaccccacacagaaaggcgacaaaggaaaggacagcggactgaaccccgaagcccctcctttcaccatccacgacctgccacgaggcaccccaggcagtgccggcttggacctgagcagccagaaagacctgatcctgtctctggaagacggcgtgtccctggtgccaaccctggtgaagggcaccctgcccgagggcaccacgggactgatcatcggcagatccagcaactacaagaaaggcctggaggtgctgcccggcgtgatcgactccgacttccagggcgaaattaaggtcatggtaaaggccgctaagaacgccgtgatcatccacaagggcgagcggatcgcgcagctgctgctgctgccttatctgaaactgcctaaccctatcatcaaggaggaaagaggcagcgagggatttggcagcacctcccacgtgcac

SEQ ID NO: 817 - DNA, 360 bp, Mouse mammary tumor virus
  source 1..360: mol_type = genomic DNA
tgggtgcaggagatcagcgacagcagacccatgctgcacatcagcctgaacggcagaagattcctgggcctgctggacaccggggccgataagacctgcatcgccggcagagattggcccgccaactggcctattcaccagaccgagagcagcctgcagggcttgggaatggcttgtggcgtggctagaagctctcagcctctgagatggcagcacgaggataagtctggcattatccatcctttcgtgatccccacattgccttttaccctctggggccgggacatcatgaaagagataaaggtgcggctgatgaccgatagcccagacgacagccaggatctgacatctctgtacggc

SEQ ID NO: 818 - DNA, 300 bp, Mason-Pfizer monkey virus
  source 1..300: mol_type = genomic DNA
atgggccaggagctgtcccagcacgagcggtacgtggagcagctgaagcaagcccttaaaacaagaggcgtgaaggtgaaatacgccgacctgctgaagttcttcgattttgtgaaggatacctgcccttggttccctcaggagggcaccatcgacatcaagagatggcgcagagtgggcgactgcttccaagattactacaacaccttcggacctgagaaagtgcctgtgaccgccttcagctactggaacctgatcaaggaactgatcgacaaaaaggaagtgaacccacaggtgatg

SEQ ID NO: 819 - DNA, 348 bp, Mason-Pfizer monkey virus
  source 1..348: mol_type = genomic DNA
gctgctgtcgcccagaccgaggaaatcctgaagagcaacagccagacagacctgaccaagaccagccagaaccctgacctggatctgatcagcctggacagcgatgatgagggcgccaagtccagcagcctgcaggacaagggcctgagcagcaccaaaaagcctaagcggttccccgtcctgctgaccgcccagacaagcaaggacccagaggatcctaacccaagcgaggtggactgggacggcctggaggacgaggccgctaagtaccacaaccctgactggccccccttcctgacaagacctccaccttacaacaaggctacccctagcgcccctaccgtgatg

SEQ ID NO: 820 - DNA, 249 bp, Mason-Pfizer monkey virus
  source 1..249: mol_type = genomic DNA
gccgtggtgaaccctaaagaggaactgaaagaaaagatcgcccagctggaagagcagatcaaactggaagagctgcaccaggccctgatttctaagctgcaaaagctgaaaaccggcaacgagacagtcactcaccctgatacagccggaggcctgagcagaacaccacattggcccggccagcacatccctaagggcaagtgctgcgccagccgggaaaaggaagagcagatccccaaggatatcttc

SEQ ID NO: 821 - DNA, 678 bp, Mason-Pfizer monkey virus
  source 1..678: mol_type = genomic DNA
cctgtgaccgaaaccgttgacggacagggccaggcatggagacaccacaatggcttcgacttcgccgtgatcaaggaactgaagacagccgcctctcaatacggcgccaccgcaccttacaccctggctatcgtggaatccgtcgccgacaactggctgaccccaaccgactggaataccctggtgcgggccgtgctgtctggcggcgaccacctgctctggaagtctgagttcttcgagaactgtagggacaccgctaagcggaaccagcaggccggcaatggatgggattttgacatgctgaccggcagcggcaactacagctctacagacgcccaaatgcagtacgaccctggcctgttcgcccagattcaggccgctgccacaaaggcctggcggaagctgcccgtgaagggggatcccggcgccagcctgaccggcgtgaagcagggccccgatgagcctttcgccgacttcgtgcatagactgatcaccacagccggcagaatcttcggctccgccgaagccggcgtggactacgtgaagcagctggcttacgagaacgccaaccctgcctgccaggccgcaatcagaccctatagaaagaagacagatctgaccggctacatccggctgtgcagcgacatcggcccttcctatcagcagggactggctatg

SEQ ID NO: 822 - DNA, 694 bp, Mason-Pfizer monkey virus
  source 1..694: mol_type = genomic DNA
gccgctgcctttagcggccagaccgtgaaggacttcctgaacaacaagaacaaggaaaagggcggatgttgttttaagtgcggcaagaaaggacactttgccaaaaactgccacgagcacgcccacaacaacgccgagcccaaggtgcccggcctgtgtcctcggtgcaagagaggcaagcactgggccaatgagtgcaagtccaagacagataaccagggaaatccaatccccccccatcagggaaatggtgcttctcctagacctagaaacaagctgatgggccaaagcgccctgttccagcctaccaagacaacccacttcaaggcctaccagagccaccccagaaagtgcagaatcggccctctgttccacctgccccacagcatcaacgcctgaaatggggccccaagcgttaagcactggaatatatggaccactgcctcccaacacttttggattaatcctaggccgaagtagcattactatgaagggtctacaagtttatccaggagtaattgataatgactataccggagaaattaaaattatggcaaaagctgttaacaatattgttactgtctctcaaggcaacagaatagctcaattaatcctcctgcctctgatcgagacagacaataaggtacaacaaccttatagaggacaaggaagttttggatcctcagacatatat

SEQ ID NO: 823 - DNA, 459 bp, Mason-Pfizer monkey virus
  source 1..459: mol_type = genomic DNA
tgggtccagcctatcacctgtcagaagccttctctgaccctgtggctggacgacaagatgttcaccggcctcatcgacaccggcgccgacgtgacaatcatcaagctggaagattggcctccaaattggcccattacagataccctgaccaacctgagaggcatcggacagtccaacaaccccaagcagagcagcaagtacctgacatggcgggacaaggagaacaacagcggcctgatcaaaccttttgtgatccccaatctgcctgtgaacctgtggggaagagatctgctgtctcagatgaagatcatgatgtgcagcccaaacgacatcgtgaccgcccagatgctggctcaaggctacagccccggcaaaggcctgggcaagaaagagaatggaatcctgcaccctatccctaaccagggccagagcaacaagaagggcttcggcaacttctga

SEQ ID NO: 824 - DNA, 300 bp, Mason-Pfizer monkey virus
  source 1..300: mol_type = genomic DNA
atggggcaagaattaagccagcatgaacgttatgtagaacaattgaagcaggctttaaagacacggggagtaaaggttaaatatgctgatcttttgaaattttttgattttgtgaaggatacttgtccttggtttccgcaagagggaaccatagatattaaacggtggcgtagagtaggcgactgtttccaagactattacaatacttttggcccggagaaagtcccagtaactgcattctcttactggaacttaattaaagaattgatagataagaaagaagttaacccacaagtaatg

SEQ ID NO: 825 - DNA, 348 bp, Mason-Pfizer monkey virus
  source 1..348: mol_type = genomic DNA
gctgccgtagcccaaactgaagaaattttaaaaagtaattctcaaacagacctcacaaagacctctcaaaacccagacttggaccttatttcccttgatagcgacgatgaaggagctaaaagttcctctctacaagataaaggtttatcaagtactaaaaaaccaaaaagattcccagttctgttaacagcacaaactagtaaagaccctgaagaccccaacccctcagaggtagactgggacggcttggaagatgaggcagcgaaatatcataatcccgattggcctcccttcctaacccgtccacctccttacaataaagctactccttccgcacccactgtaatg

SEQ ID NO: 826 - DNA, 249 bp, Mason-Pfizer monkey virus
  source 1..249: mol_type = genomic DNA
gcggttgttaatccaaaagaggagctcaaagaaaaaattgctcaattagaggaacagattaaattagaagagttacaccaggcactaatttccaaattacaaaaactaaaaacagggaatgaaactgtaactcacccagacacagcaggaggcctttctcgcacgcctcactggccagggcaacatatccctaaaggaaaatgttgcgccagtcgagaaaaggaagaacaaatcccaaaagatattttc

SEQ ID NO: 827 - DNA, 678 bp, Mason-Pfizer monkey virus
  source 1..678: mol_type = genomic DNA
ccagtgactgaaaccgttgatgggcaaggtcaagcctggagacaccataatggttttgattttgccgtcataaaagaattaaaaacagctgcttcccaatatggggctactgccccatacacattagccatagtggaatctgtagcggacaattggcttacccctacagattggaatacgcttgttagggcagtcctctcaggaggagatcacttactgtggaaatctgagttttttgaaaattgcagagatacggctaaaagaaaccaacaagccggtaatggctgggattttgacatgttaacaggttcgggtaattattccagcaccgatgcacaaatgcagtatgatccaggattgtttgctcaaattcaagcggctgctacaaaagcctggagaaaacttcccgttaagggagacccaggagcctcccttacaggagtcaaacaaggacccgatgagccatttgcagatttcgtacacagacttataacaactgctgggagaatctttggaagtgctgaggccggtgtagactatgtaaaacaactagcatatgaaaatgctaatccagcttgtcaggcagccattcgcccctatagaaagaagacagatttaactggctatatccgtctttgctcggatattgggccctcttatcagcaaggcctggccatg

SEQ ID NO: 828 - DNA, 694 bp, Mason-Pfizer monkey virus
  source 1..694: mol_type = genomic DNA
gccgccgcctttagcgggcagactgtaaaagattttcttaacaacaaaaataaagagaaaggagggtgttgctttaaatgcggtaaaaaaggacactttgcaaaaaattgtcatgaacatgcacataacaatgctgaaccaaaagttcccggactctgccctagatgtaaaagagggaaacattgggccaatgaatgcaaatccaaaactgataatcaaggaaacccaataccaccccatcagggaaacggggccagccccaggccccgaaacaagcttatggggcagtcagctttgttccagccaacaaaaacaacccatttcaaagcttaccagagccaccccaggaagtgcaggattggacctctgttccacctcccacacagtattaacgcctgaaatggggccccaagcgttaagcactggaatatatggaccactgcctcccaacacttttggattaatcctaggccgaagtagcattactatgaagggtctacaagtttatccaggagtaattgataatgactataccggagaaattaaaattatggcaaaagctgttaacaatattgttactgtctctcaaggcaacagaatagctcaattaatcctcctgcctctgatcgagacagacaataaggtacaacaaccttatagaggacaaggaagttttggatcctcagacatatat

SEQ ID NO: 829 - DNA, 459 bp, Mason-Pfizer monkey virus
  source 1..459: mol_type = genomic DNA
tgggtccaacctattacttgtcaaaaaccttccttaacattatggttagatgacaaaatgttcacaggcttaatagatacgggggctgatgtcacaattatcaagctggaggactggcctcctaattggcctataacagataccttaaccaatttaagaggaataggacaaagtaacaaccctaaacaaagttctaaatatcttacttggagagataaagaaaacaattctggtctcatcaaaccgtttgttattcctaacttacctgtcaatctttggggccgagatttactttctcaaatgaaaattatgatgtgtagccccaatgacatagtaactgctcaaatgttagcccagggctacagcccaggaaaagggttaggaaaaaaggaaaatggcattctacatcctatcccaaatcaaggacaatctaacaaaaaaggttttggaaatttttaa

SEQ ID NO: 830 - DNA, 327 bp, Bovine leukemia virus
  source 1..327: mol_type = genomic DNA
atgggcaactctcctagctacaatccccctgccggcatctccccatctgactggctgaacctgctgcagtccgcccagcgcctgaatccaaggcctagcccatccgacttcacagatctgaagaactatatccactggtttcacaagacccagaagaagccttggaccttcacaagcggaggaccaacatcctgcccaccaggcagatttggaagggtgccactggtgctggccaccctgaacgaggtgctgtccaatgagggaggagcacctggagcctctgccccagaggagcagcctccaccctacgaccctccagccatcctg

SEQ ID NO: 831 - DNA, 639 bp, Bovine leukemia virus
  source 1..639: mol_type = genomic DNA
cccatcatctccgagggaaacaggaataggcacagggcatgggcactgagggagctgcaggatatcaagaaggagatcgagaataaggcccctggctctcaagtgtggatccagacactgcggctggccatcctgcaggcagacccaacccctgcagatctggagcagctgtgccagtacatcgccagccctgtggaccagaccgcccacatgacatccctgaccgcagcaatcgcagcagcagaggcagcaacacccagcagagtgctgacccctaagaccggcacactgacccagcagtctgcccagccaaacgcaggcgatctgaggagccagtatcagaatctgtggctgcaggccggcaagatctccctgctggtgctgcagctgcagccctggtctaccatcgtgcagggacctgcagagagctccgtggagtttgtgaaccgcctgcagatctccctggccgacaacctgccagatggcgtgctgcggaatcccctgctgacacctctggtcatgcagatgctgaccgagtctgtgagcaagttctgcaggggagaggccagcggaaggggaggagccaagacagcaggactgagaaccatcggaccacctaggatgaagcagcctgccctg

SEQ ID NO: 832 - DNA, 291 bp, Bovine leukemia virus
  source 1..291: mol_type = genomic DNA
ctggtgcacaccccaggaccaaagatgcctggaccacgccagccagcacctaagaggccaccacctggaccttgctacagatgtctgaaggagggacactgggccagggactgcccaacaaaggcaaccggcccaccacctggaccatgccccatctgtaaggacccaagccactggaagcgcgattgtcccacactgaagtccaagaatctaatagaggggggacttagcgccccccaaaccataacacctataacagattctcttagtgaggccgaattagaatgctta

SEQ ID NO: 833 - DNA, 378 bp, Bovine leukemia virus
  source 1..378: mol_type = genomic DNA
ctctctattcctctggcccggagccgccctagcgtggccgtgtacctgagcggcccttggctgcaaccttctcagaaccaggccctgatgctggttgatacaggcgccgagaacaccgtgctgcctcagaattggctggtgcgggactaccccagaatccctgccgctgtgctgggagccggaggcgtgtcccggaacagatacaactggctgcagggccctcttacactggctctgaaacctgaaggcccattcatcaccatcccaaagatcctggtcgacaccttcgacaagtggcagatcctgggcagagatgtgctgagcagactgcaggccagcatcagcatccccgaggaagtgcggccccccgtggtgggc

SEQ ID NO: 834 - DNA, 40 bp, Bovine leukemia virus
  source 1..40: mol_type = genomic DNA
aggtgccccagccatcctgcccatcatctccggcggcagc

SEQ ID NO: 835 - DNA, 18 bp, Bovine leukemia virus
  source 1..18: mol_type = genomic DNA
cccatcatctccgaggga

SEQ ID NO: 836 - DNA, 390 bp, Human T-cell leukemia virus type I
  source 1..390: mol_type = genomic DNA
atgggtcagattttcagcagaagcgcctcccctattcctagacctccacggggcctggccgcccaccactggctgaatttcctgcaggccgcttatagactggagcctggaccttccagctacgacttccaccagctgaagaaattcctgaagatcgccctggaaacccctgccagaatctgccctatcaactacagcctgctggcctccctgctgcccaagggctaccctggcagagtgaacgagatccttcatatcctgatccagacacaggctcagatcccctctaggcccgctccacctcctccaagcagcccaacccacgatcctcctgatagcgaccctcagatccccccaccatacgtggagcccaccgcccctcaagtgctg

SEQ ID NO: 837 - DNA, 642 bp, Human T-cell leukemia virus type I
  source 1..642: mol_type = genomic DNA
ccagtgatgcacccccacggcgcccctcctaatcacagaccttggcagatgaaagacctgcaggccatcaagcaggaagtgtcccaggccgctcctggcagcccccaatttatgcagaccatcagactcgccgttcagcagttcgaccccacagccaaggatctgcaggacctgctgcagtacctgtgtagcagcctggtcgccagcctgcaccatcagcaactggattctctgatcagcgaggccgagacaagaggcatcaccggctacaaccctctggccggccccctgcgggtgcaggcaaacaacccccagcagcaggggctgcggagagagtaccagcagctgtggctggctgctttcgccgcactgcctggaagcgccaaagatccatcttgggcctctatcctgcagggcctggaagaaccttaccacgcctttgtggaaagactgaacatcgccctggacaacggcctgcctgagggcacccctaaggaccccatcctgagatctctggcctacagcaacgccaacaaggaatgtcagaagctgctgcaagccagaggccacaccaacagccccctgggcgacatgctgcgcgcctgccagacctggacccctaaggacaagaccaaggtgctg

SEQ ID NO: 838 - DNA, 314 bp, Human T-cell leukemia virus type I
  source 1..314: mol_type = genomic DNA
gtggtgcagcctaagaagcctccccctaatcagccctgcttccggtgcggcaaggccggacactggagccgggactgcacccagcctcggcctccaccgggaccttgtcctctgtgccaagaccccacacactggaagagagattgcccccgcctaaagcccactatcccagaaccagagccagaggaagatgccctcctattagacctccccgctgacattccacacccaaaaaactccatagggggggaggtttaacctctcctcctaccctgcagcaggtgttcctgaatcaagatcctgccagcatcctg

SEQ ID NO: 839 - DNA, 546 bp, Human T-cell leukemia virus type I
  source 1..546: mol_type = genomic DNA
acctcccaccccaaaacaatcgaggccctgctggacaccggcgctgatatgacagtgctgccaatcgccctgttcagcagcaacacccctctgaaaaacaccagcgtgctcggagccggcggacagacccaggaccacttcaagctgacaagcctgcctgtcctgatccggctgcccttcagaaccacacctatcgtgctgaccagctgcctggtggacacaaagaacaactgggccatcatcggcagggacgccctgcaacagtgccagggcgtgctgtacctgccagaggccaagggcccccccgttatcctgcctatccaggcccctgccgtgctgggcctggaacacctgccaagacccccccagatcagccaatttcctctgaaccagaacgccagcagaccatgtaatacctggtccggcagaccttggcggcaggccatttctaaccccacccccggccaggagatcacccagtacagccagctgaagcggcctatggaacctggagattctagcaccacctgcggccctctgacactg

SEQ ID NO: 840 - DNA, 39 bp, Human T-cell leukemia virus type I
  source 1..39: mol_type = genomic DNA
ggtgcccctcaagtgctgccagtgatgcacggcggcagc

SEQ ID NO: 841 - DNA, 18 bp, Human T-cell leukemia virus type I
  source 1..18: mol_type = genomic DNA
ccagtgatgcacccccac

SEQ ID NO: 842 - DNA, 390 bp, Human T-cell leukemia virus type I
  source 1..390: mol_type = genomic DNA
atgggccaaatcttttcccgtagcgctagccctattccgcgaccgccccgggggctggccgctcatcactggcttaacttcctccaggcggcatatcgcctagaacccggtccctccaattgcgctttccacctgttaagaagatatcatgaaacagtttccggaataccggctcggatctgtcccattaactactccctcctagccagcctactcccaaaaggataccccggccgggtgaatgaaattttacacatactcatccaaacccaagcccagatcccgtcccgtcccgcgccaccgccgccgtcatcccccacccacgaccccccggattctgatccacaaatcccccctccctatgttgagcctacggccccccaagtcctt

SEQ ID NO: 843 - DNA, 642 bp, Human T-cell leukemia virus type I
  source 1..642: mol_type = genomic DNA
ccagtcatgcatccacatggtgctcctcctaaccatcgcccatggcaaatgaaagacctacaggccattaagcaagaagtctcccaagcagcccctgggagcccccagtttatgcagaccatccggcttgcggtgcagcagtttgaccccactgccaaagacctccaagacctcctgcagtacctttgctcctccctcgtggcttccctccatcaccagcagctagatagccttatatcagaggccgaaacccgaggtattacaggttataacccattagccggtcccctccgtgtccaagccaacaatccacaacaacaaggattaaggcgagaataccagcaactctggctcgccgccttcgccgccctgccggggagtgccaaagacccttcctgggcctctatcctccaaggcctggaggagccttaccacgccttcgtagaacgcctcaacatagctcttgacaatgggctgccagaaggcacgcccaaagaccccatcttacgttccttagcctactccaatgcaaacaaagaatgccaaaaattactacaggcccgaggacacactaatagccctctaggagatatgttgcgggcttgtcagacctggacccccaaagacaaaaccaaagtgtta

SEQ ID NO: 844 - DNA, 314 bp, Human T-cell leukemia virus type I
  source 1..314: mol_type = genomic DNA
gttgtccagcctaaaaaaccccccccaaatcagccgtgcttccggtgcgggaaagcaggccactggagtcgggactgcactcagcctcgtcccccccccgggccatgccccctatgtcaagacccaactcactggaagcgagactgcccccgcctaaagcccactatcccagaaccagagccagaggaagatgccctcctattagacctccccgctgacattccacacccaaaaaactccatagggggggaggtttaacctccccccccacattacagcaagtctttcttaaccaagacccagcatctattctg

SEQ ID NO: 845 - DNA, 606 bp, Human T-cell leukemia virus type I
  source 1..606: mol_type = genomic DNA
ccagttataccgttagatcccgcccgtcggcccgtaattaaagcccaggttgacacccagaccagccacccaaagactatcgaagctctactagatacaggagcagacatgacagtccttccgatagccttgttctcaagtaatactcccctcaaaaatacatccgtattaggggcagggggccaaacccaagatcactttaagctcacctcccttcctgtgctaatacgcctccctttccggacaacgcctattgttttaacatcttgcctagttgataccaaaaacaactgggccatcataggtcgcgatgccttacaacaatgccagggcgtcctgtacctccctgaggcaaaagggccgcctgtaatcttgccaatacaggcgccagccgtccttggactagaacacctcccaaggcccccccaaatcagccagttccctttaaaccagaacgcctccaggccttgcaacacttggtccggaaggccctggaggcaggccatatcgaatcctacaccgggccaggaaataacccagtattcccagttaaaaaggccaatggaacctggcgattcatccacgacctgcgggccactaactctc

SEQ ID NO: 846 - DNA, 36 bp, Human T-cell leukemia virus type I
  source 1..36: mol_type = genomic DNA
gcccctcaagtgctgccagtgatgcacggcggcagc

SEQ ID NO: 847 - DNA, 18 bp, Human T-cell leukemia virus type I
  source 1..18: mol_type = genomic DNA
ccagtcatgcatccacat

SEQ ID NO: 848 - DNA, 285 bp, Walleye dermal sarcoma virus
  source 1..285: mol_type = genomic DNA
atgggcaatagctcctctaccccccctccaagcgccctgaagaactccgatctgttcaagaccatgctgaggacacagtacagcggctccgtgaagacacggagaatcaaccaggatatcaagaagcagtatccactgtggccagaccagggaacctgcgcaacaaagcactgggagcaggccgtgctgatccccctggactctgtgagcgaggagaccgccaaggtgctgaatttcctgcgggtgaagatccaggccagaaagggagagaccgcaaggcagatg

SEQ ID NO: 849 - DNA, 468 bp, Walleye dermal sarcoma virus
  source 1..468: mol_type = genomic DNA
accgcacacacaatcaagaagctgatcgtgggcacaatcgataagaacaagcagcagaccgagatcctgcagaagacagacgagagcgatgaggagatggacaccacaaataccatgctgtttatcgcccgcaacaagagggagaggatcgcacagcagcagcaggcagatctggcagcacagcagcaggtgctgctgctgcagagggagcagcagagggagcagagagagaaggatatcaagaagcgggacgagaagaagaagaagctgctgcccgacaccacacagaaggtggagcagaccgatatcggagaggccagctcctctgacgcctccgcccagaagccaatctctaccgacaacaatcccgatctgaaggtggacggcgtgctgacaagaagccagcacaccacagtgccttccaacatcaccatcaagaaggatggcacatccgtgcagtaccagcac

SEQ ID NO: 850 - DNA, 618 bp, Walleye dermal sarcoma virus
  source 1..618: mol_type = genomic DNA
cccatcaggaactatcctaccggcgagggcaatctgacagcccaggtgcggaacccttttagaccactggagctgcagcagctgaggaaggactgccccgccctgcctgagggcatcccacagctggccgagtggctgacccagacaatggccatctacaattgtgacgaggccgatgtggagcagctggccagagtgatcttcccaacccctgtgaggcagatcgcaggcgtgatcaacggacacgcagcagcaaataccgcagccaagatccagaactacgtgacagcatgcaggcagcactatccagccgtgtgcgattggggcaccatccaggcctttacatacaagccccctcagaccgcccacgagtatgtgaagcacgccgagatcatcttcaagaacaatagcggactggagtggcagcacgcaaccgtgccttttatcaatatggtggtgcagggcctgccacccaaggtgacacggtccctgatgtctggcaacccagattggagcaccaagacaatcccacagatcatccccctgatgcagcactacctgaatctgcagtccagacaggacgccaagatcaagcagacccctctggtgctgcagctg

SEQ ID NO: 851 - DNA, 381 bp, Walleye dermal sarcoma virus
  source 1..381: mol_type = genomic DNA
gccatgccagcccagacaatgaacggcaataagggctacgtgggctcctatcctaccaacgagccatactattctttccagcagcagcagaggccagcacccagagcccctccaggcaacgtgccttccaatacctgcttcttttgtaagcagccaggacactggaaggcagactgccctaataagacaaggaacctgcgcaatatgggcaacatgggaaggggaggaagaatgggaggaccaccttaccggagccagccttatccagcctttatccagccaccccagaatcaccagaaccagtataatggcaggatggatcgctctcagctgcaggccagcgcccaggagtggctgccaggaacctaccctgcacgagac

SEQ ID NO: 852 - DNA, 429 bp, Walleye dermal sarcoma virus
  source 1..429: mol_type = genomic DNA
ccaatcgattgcccctatgagaagagcggcacaaagaccacacaggacgtgatcaccacaaagaatgccgagatcatggtgaccgtgaaccacacaaagatcccaatgctggtggataccggcgcctgtctgacagcaatcggaggagcagcaaccgtggtgccagacctgaagctgaccaacacagagatcatcgcagtgggaatctctgccgagcccgtgcctcacgtgctggccaagccaaccaagatccagatcgagaacacaaatatcgatatcagcccttggtacaatccagaccagaccttccacatcctgggccgcgacacactgtctaagatgcgggccatcgtgagctttgagaagaacggcgagatgaccgtgctgctgcctccaacatatcacaagcagctgtcctgtcagaccaag

SEQ ID NO: 853 - DNA, 39 bp, Walleye dermal sarcoma virus
  source 1..39: mol_type = genomic DNA
ggtgccgcaaggcagatgaccgcacacacaggcggcagc

SEQ ID NO: 854 - DNA, 381 bp, Feline leukemia virus
  source 1..381: mol_type = genomic DNA
atgggccagacaatcacaacccctctgagcctgaccctggaccactggagtgaagtgcgggctagagcccacaaccagggcgtggaagtccggaaaaaaaagtggatcaccctgtgcgaggccgagtgggtcatgatgaacgtgggatggcctagagagggtacatttagcctggacaacatcagccaggttgagaaaaagattttcgctcctggcccttacggccatcctgaccaggtgccttacatcaccacatggcggagcctggctaccgacccaccaagctgggtgcggcccttcctgcctcctcccaagccccccacccctctgcctcagcctctgagcccccagccctctgcccctctgaccagctctctgtac

SEQ ID NO: 855 - DNA, 210 bp, Feline leukemia virus
  source 1..210: mol_type = genomic DNA
cctgtgctgcctaagtccgatccccctaaacctcctgttttacctcccgaccctagcagcccactgatcgacctgctgacggaagaacctcctccttatcctggcggacatggccccccaccttctggccctcggaccccaaccgcctcccctatcgcctctagactgagagagcggagagaaaaccccgccgaagagtcccaagccctg

SEQ ID NO: 856 - DNA, 744 bp, Feline leukemia virus
  source 1..744: mol_type = genomic DNA
cccctgagagagggccctaacaaccggcctcagtactggcccttcagcgccagcgatctgtataactggaagtcccacaatcctcctttcagccaggatcctgtggccctgacaaacctgatcgagtctatcctggtgactcaccagccaacctgggatgactgccagcagctgctgcaggccctcctgaccggcgaagagagacagagagtgctgctggaggccagaaagcaggtgcctggagaggacggcaggcctacccagctgcctaatgtgatcgacgagacattccccctgaccagaccaaattgggacttcgccaccccagctggcagagagcacctgcgcctgtaccggcagcttctgctggccggactgagaggcgctgccagaagaccaaccaacctggctcaggtgaagcaggtcgtgcagggcaaagaggagacacccgccgctttcctggaacggctgaaggaggcctacagaatgtacaccccttacgaccccgaagatccaggacaggccgccagcgtgatcctgagcttcatctaccagagcagccctgacatcagaaacaagctgcagcggctggaaggcctgcagggcttcacactgagcgacctgctcaaggaggccgagaagatctacaacaagcgggaaacccctgaggaaagagaagagagattgtggcagcggcaagaggagcgggacaaaaagcggcacaaggaaatgaccaaggtgctg

SEQ ID NO: 857 - DNA, 171 bp, Feline leukemia virus
  source 1..171: mol_type = genomic DNA
gctaccgtggtggcccagaacagagataaagacagagaggaatcgaagctgggcgaccagagaaagatcccccttggcaaggaccaatgtgcctactgcaaggaaaaaggccactgggtgagggactgtcccaagagacccagaaagaagcccgcaaacagcacactgctg

SEQ ID NO: 858 - DNA, 375 bp, Feline leukemia virus
  source 1..375: mol_type = genomic DNA
aacctgggcgatcaggagagccaaggccaggacccccctcctgagcctagaatcaccctgaagattggaggccagcctgtgacctttctggtggacaccggcgcccaacactctgtgctgaccagacctgatggccccctcagcgatagaaccgccctggtccagggagctacaggcagcaagaactacagatggaccaccgacagaagggtgcagctggctactggcaaggtgacacacagctttctgtacgtgcccgagtgcccttaccccctcctgggcagagatctgttgacaaagctgaaggcccaaatccacttcaccggagagggcgctaatgtggtgggccccaagggcctgcctcttcaggtgctg

SEQ ID NO: 859 - DNA, 39 bp, Feline leukemia virus
  source 1..39: mol_type = genomic DNA
ggtgccagctctctgtaccctgtgctgcctggcggcagc

SEQ ID NO: 860 - DNA, 393 bp, Moloney murine leukemia virus
  source 1..393: mol_type = genomic DNA
atgggccagaccgtgaccacacccctgtccctgacactgggccactggaaggacgtggagcggatcgcccacaatcagtctgtggatgtgaagaagcggagatgggtgaccttctgcagcgccgagtggcccaccttcaacgtgggctggccaagggacggcaccttcaaccgcgatctgatcacacaggtgaagatcaaggtgtttagcccaggacctcacggacacccagaccaggtgccttatatcgtgacctgggaggccctggccttcgatccacctccatgggtgaagccatttgtgcacccaaagccacctccaccactgcctccatccgccccttctctgccactggagccacctcggtccaccccaccaagaagctccctgtat

SEQ ID NO: 861 - DNA, 252 bp, Moloney murine leukemia virus
  source 1..252: mol_type = genomic DNA
cctgccctgacaccatctctgggcgccaagccaaagccacaggtgctgtctgacagcggaggacctctgatcgacctgctgaccgaggatcctccaccctacagagatccaaggcctccaccatccgacagggatggaaacggaggagaggcaacaccagcaggagaggcccctgacccatcccccatggcctctagactgaggggcaggcgcgagcctccagtggcagatagcaccacatcccaggcattc

SEQ ID NO: 862 - DNA, 789 bp, Moloney murine leukemia virus
  source 1..789: mol_type = genomic DNA
ccactgagggcaggaggaaatggccagctgcagtattggcccttttctagctccgacctgtacaactggaagaacaataacccatccttctctgaggatcccggcaagctgaccgccctgatcgagagcgtgctgatcacccaccagcccacatgggacgattgtcagcagctgctgggcaccctgctgacaggcgaggagaagcagcgggtgctgctggaggcaaggaaggccgtgagaggcgacgatggcagacccacccagctgcctaatgaggtggacgcagcatttccactggagaggccagactgggattataccacacaggccggcaggaaccacctggtgcactacaggcagctgctgctggccggactgcagaatgcaggcaggtcccctaccaacctggccaaggtgaagggcatcacacagggccctaatgagagcccatccgcctttctggagcgcctgaaggaggcctaccggagatataccccctacgaccctgaggatccaggccaggagacaaacgtgtctatgagcttcatctggcagtctgccccagacatcggaaggaagctggagcgcctggaggacctgaagaataagaccctgggcgatctggtgcgggaggcagagaagatcttcaacaagagagagacacctgaggagagggaggagcggatcaggagggagaccgaggagaaggaggagcggagaaggacagaggacgagcagaaggagaaggagcgggatcgccggagacacagagagatgagcaagctgctg

SEQ ID NO: 863 - DNA, 180 bp, Moloney murine leukemia virus
  source 1..180: mol_type = genomic DNA
gccaccgtggtgtccggacagaagcaggacaggcagggaggagagaggcgccggtctcagctggaccgcgatcagtgcgcctactgtaaggagaagggccactgggccaaggattgccccaagaagcctagaggcccaaggggccctaggccacagaccagcctgctgacactggacgat

SEQ ID NO: 864 - DNA, 378 bp, Moloney murine leukemia virus
  source 1..378: mol_type = genomic DNA
acactggacgatcaaggaggacagggacaggagccacctccagagcccagaatcaccctgaaggtcggcggccagcctgtgacctttctggtggacacaggcgcccagcacagcgtgctgacccagaatcccggccctctgtctgataagagcgcctgggtgcagggagcaacaggcggcaagcggtacagatggaccacagaccggaaggtgcacctggccaccggcaaggtgacacacagctttctgcacgtgcccgactgtccataccccctgctgggcagagatctgctgaccaagctgaaggcacagatccacttcgagggatccggagcacaggtcatgggaccaatgggacagcctctgcaggtgctgaca

SEQ ID NO: 865 - DNA, 57 bp, Moloney murine leukemia virus
  source 1..57: mol_type = genomic DNA
ctgaacatcgaggatgagggtgccagctccctgtatcctgccctgacaggcggcagc

SEQ ID NO: 866 - DNA, 459 bp, Caprine arthritis encephalitis virus
  source 1..459: mol_type = genomic DNA
atggtgtctctggacagggatatggcaaggcaggtgagcggaggcaagagggattacccagagctggagaagtgcatcaagcacgcctgtaagatcaaggtgcggctgagaggagagcacctgaccgagggcaactgcctgtggtgtctgaagacactggactatatgttcgaggatcacaaggaggagccctggaccaaggtgaagtttagaacaatctggcagaaggtgaagaacctgacccctgaggagagcaataagaaggacttcatgtccctgcaggccacactggccggcctgatgtgctgtcagatgggcatgaggccagagaccctgcaggacgccatggccacagtgatcatgaaggatggcctgctggagcaggaggagaagaaggaggataagcgcgagaaggaggagagcgtgtttccaatcgtggtgcaggcagcaggaggccgg

SEQ ID NO: 867 - DNA, 636 bp, Caprine arthritis encephalitis virus
  source 1..636: mol_type = genomic DNA
tcctggaaggccgtggactctgtgatgttccagcagctgcagaccgtggcaatgcagcacggactggtgagcgaggattttgagagacagctggcctactatgccaccacatggacatccaaggacatcctggaggtgctggccatgatgcccggcaacagagcccagaaggagctgatccagggcaagctgaatgaggaggccgagaggtggcggagaaacaatccacctccaccagcaggaggaggactgaccgtggatcagatcatgggagtgggacagacaaaccaggcagcagcacaggcaaatatggaccaggccagacagatctgcctgcagtgggtcatcaacgcactgagggccgtgagacacatggcacacaggcccggcaaccctatgctggtgaagcagaagaccaatgagccttacgaggacttcgccgccagactgctggaggccatcgatgccgagccagtgacacagcccatcaaggactacctgaagctgaccctgagctatacaaatgcctccgccgactgccagaagcagatggatagaaccctgggacagagggtgcagcaggcctccgtggaggagaagatgcaggcctgtagggatgtgggctctgagggcttt

SEQ ID NO: 868 - DNA, 249 bp, Caprine arthritis encephalitis virus
  source 1..249: mol_type = genomic DNA
aagatgcagctgctggcccaggccctgaggcctggcaagggcaagggaaacggacagccacagcggtgctacaattgtggcaagccaggacaccaggcaaggcagtgcaggcagggcatcatatgtcacaactgtggaaagagaggacatatgcaaaaagaatgcagaggaaagagagacataaggggaaaacagcagggaaacgggaggagggggatacgtgtggtgccgtccgctcctcctatggaa

SEQ ID NO: 869 - DNA, 477 bp, Caprine arthritis encephalitis virus
  source 1..477: mol_type = genomic DNA
atgtcacaactgtggaaagagaggacatatgcaaaaagaatgcagaggaaagagagacataaggggaaaacagcagggaaacgggaggagggggatacgtgtggtgccgtccgctcctcctatggaataacaagcgcccctccaatggtgcaggtgcggattggatctcagcagcgcaacctgctgttcgacaccggcgccgatagaaccatcgtccggtggcacgagggctccggcaaccccgccggcagaatcaaactgcaaggcatcggcggaatcgtggaaggcgagaagtggaacaacgtggagctggaatacaagggcgagacaagaaagggcaccatcgtggtgctgcctcagagccctgtggaggtgctgggacgggacaacatggcccggttcggcatcaagatcatcatggctaatctggaggaaaaaagaatccccatcaccaaggtgaagttgaaagagggatgt

SEQ ID NO: 870 - DNA, 39 bp, Caprine arthritis encephalitis virus
  source 1..39: mol_type = genomic DNA
ggtgccgcaggaggccggtcctggaaggccggcggcagc

SEQ ID NO: 871 - DNA, 18 bp, Caprine arthritis encephalitis virus
  source 1..18: mol_type = genomic DNA
tcctggaaggccgtggac

SEQ ID NO: 872 - DNA, 372 bp, Equine infectious anemia virus
  source 1..372: mol_type = genomic DNA
atgggcgatcctctgacatggagcaaggccctgaagaagctggagaaggtgaccgtgcagggcagccagaagctgaccacaggcaactgcaattgggccctgtccctggtggacctgttccacgatacaaactttgtgaaggagaaggattggcagctgcgcgacgtgatcccactgctggaggacgtgacccagacactgtctggccaggagcgggaggccttcgagagaacctggtgggccatcagcgccgtgaagatgggcctgcagatcaacaatgtggtggatggcaaggcctcttttcagctgctgagggccaagtacgagaagaagacagccaacaagaagcagtctgagcctagcgaggagtat

SEQ ID NO: 873 - DNA, 690 bp, Equine infectious anemia virus
  source 1..690: mol_type = genomic DNA
ccaatcatgatcgacggcgccggcaaccggaatttcagaccactgacccccagaggctacaccacatgggtgaacacaatccagaccaacggcctgctgaatgaggcctcccagaatctgttcggcatcctgagcgtggattgtacctccgaggagatgaatgcctttctggacgtggtgccaggacaggcaggacagaagcagatcctgctggacgccatcgataagatcgccgacgattgggataaccggcacccactgcccaatgcacctctggtggcaccacctcagggacctatcccaatgacagccaggtttatcaggggactgggagtgccacgggagagacagatggagcccgccttcgaccagtttaggcagacctaccgccagtggatcatcgaggccatgagcgagggcatcaaagtgatgatcggcaagccaaaggcacagaacatcaggcagggagccaaggagccctatcctgagttcgtggatagactgctgtcccagatcaagtctgagggccaccctcaggagatctccaagtttctgaccgacacactgaccatccagaacgccaatgaggagtgccggaatgccatgcggcacctgagaccagaggataccctggaggagaagatgtacgcctgtagagacatcggcaccacaaagcagaagatgatgctg

SEQ ID NO: 874 - DNA, 453 bp, Equine infectious anemia virus
  source 1..453: mol_type = genomic DNA
ctggccaaggccctgcagacaggcctggccggaccattcaagggaggcgccctgaagggcggccccctgaaggccgcccagacctgctataactgtggcaagccaggacacctgagctcccagtgcagggcaccaaaggtgtgcttcaagtgtaagcagcctggccacttttctaagcaatgcagaagtgttccaaaaaacgggaagcaaggggctcaagggaggccccagaaacaaactttcccgatacaacagaagagtcagcacaacaaatctgttgtacaagagactcctcagactcaaaatctgtacccagatctgagcgaaataaaaaaggaatacaatgtcaaggagaaggatcaagtagaggatctcaacctggacagtttgtgggagtaaacatataacctggagaagcgccccaccacaatcgtgctgatcaacgacacccct

SEQ ID NO: 875 - DNA, 243 bp, Equine infectious anemia virus
  source 1..243: mol_type = genomic DNA
ctgaacgtgctgctggacacaggagctgatacatctgtgctcaccaccgcccactacaaccggctgaagtacagaggcagaaagtaccagggcaccggcatcatcggcgtgggcggaaatgtggaaaccttcagcaccccagtgaccattaagaaaaagggccggcacatcaaaaccagaatgctggtcgccgacatccctgtgacaatcctgggcagagatatccttcaggacttaggtgca

SEQ ID NO: 876 - DNA, 39 bp, Equine infectious anemia virus
  source 1..39: mol_type = genomic DNA
ggtgccagcgaggagtatccaatcatgatcggcggcagc

SEQ ID NO: 877 - DNA, 18 bp, Equine infectious anemia virus
  source 1..18: mol_type = genomic DNA
ccaatcatgatcgacggc

SEQ ID NO: 878 - DNA, 405 bp, Simian immunodeficiency virus
  source 1..405: mol_type = genomic DNA
atgggcgccaggaacagcgtgctgtccggcaaggaggccgatgagctggagaaggtgcggctgagacccaatggcaagaagaagtacatgctgaagcacgtggtgtgggcagcaaacgagctggaccgcttcggcctggccgagtctctgctggataataaggagggctgccagaagatcctgagcgtgctggcccctctggtgccaaccggctctgagaacctgaagagcctgtataatacagtgtgcgtgatctggtgtatccacgccgaggagaaggtgaagcacaccgaggaggccaagcagatcgtgcagaggcacctggtggtggagaccggcacagcagataggatgccagccaccagccgcccaacagcaccaccttccggaaggggcggcaactac

SEQ ID NO: 879 - DNA, 690 bp, Simian immunodeficiency virus
  source 1..690: mol_type = genomic DNA
cccgtgcagcaagtgggcggcaattatgtgcacctgcccctgagccctagaaccctgaacgcctgggtgaagctggtggaggagaagaagttcggagcagaggtggtgccaggatttcaggccctgtccgagggctgcacaccctacgacatcaaccagatgctgaattgcgtgggagagcaccaggcagcaatgcagatcatccgggagatcatcaacgaggaggcagcagactgggatctgcagcaccctcagccaggaccactgcctgcaggacagctgcgggagcctagaggctctgacatcgccggcaccacaagcaccgtggatgagcagatccagtggatgtacaggcagcagaacccaatccccgtgggcaatatctatcggagatggatccagctgggcctgcagaagtgcgtgcggatgtataacccaaccaatatcctggacgtgaagcagggcccaaaggagcccttccagagctacgtggacagattctacaagtccctgagagccgagcagacagatcccgccgtgaagaactggatgacccagacactgctgatccagaacgccaatcccgattgcaagctggtgctgaagggcctgggcatgaatcctaccctggaggagatgctgacagcatgtcagggagtgggaggacctggacagaaggcaaggctgatg

SEQ ID NO: 880 - DNA, 426 bp, Simian immunodeficiency virus
  source 1..426: mol_type = genomic DNA
gcagaggccctgaaggaggccctgaggcctgaccagctgccatttgccgccgtgcagcagaagggccagaggaagaccatcaagtgctggaactgtggcaaggagggacactctgccaagcagtgcagggcaccaaggcgccagggatgctggaagtgtggcaagacaggccacgtgatggccaagtgtcctgagaggcaggcaggcttcctgggactgggaccatggggcaagaagccaagaaattttcctatggcccagatgcctcagggactgatcccaaccgcaccaccagaggacccagcagtggatctgctgaagaactacatgaagatgggcaggaagcagcgcgagaatagggagcgcccttataaggaggtgacagaggacctgctgcacctgaactctctctttggagaagaccag

SEQ ID NO: 881 - DNA, 306 bp, Simian immunodeficiency virus
  source 1..306: mol_type = genomic DNA
tctctttggagaagaccagtagttacagcctacatcgaggaacagcctgtggaagtgctgctggatacaggagctgatgacagcatcgtggccggcattgagctgggacctaactacaccccaaagatcgtgggcggcatcggcggattcatcaataccaaagagtacaaggacgtgaagatcaaagtgctgggcaaggtgatcaagggcaccatcatgaccggcgacacacccatcaacatcttcggcagaaacctgctcaccgccatgggcatgtctctgaacctgcctatcgccaaggtcgag

SEQ ID NO: 882 - DNA, 39 bp, Simian immunodeficiency virus
  source 1..39: mol_type = genomic DNA
ggtgccggcggcaactaccccgtgcagcaaggcggcagc

SEQ ID NO: 883 - DNA, 18 bp, Simian immunodeficiency virus
  source 1..18: mol_type = genomic DNA
cccgtgcagcaagtgggc

SEQ ID NO: 884 - DNA, 405 bp, Simian immunodeficiency virus
  source 1..405: mol_type = genomic DNA
atgggcgcgagaaactccgtcttgtcagggaaggaagcagatgaattagaaaaagttaggttacggcccaacggaaagaaaaagtatatgttgaagcatgtagtatgggcagcaaatgaattggacagatttggattagcagaaagcctgttggataacaaagaaggttgtcaaaaaattctttcagttttagctccattagttccgacaggttcagaaaacttaaagagcctttataatactgtctgcgtcatttggtgcattcacgcagaagagaaagtgaaacatactgaggaagcaaaacaaatagtgcagagacatctagtggtggaaacaggaacagcagacagaatgccagcaacaagcagaccaacagcaccacctagtggcagaggaggaaattac

SEQ ID NO: 885 - DNA, 690 bp, Simian immunodeficiency virus
  source 1..690: mol_type = genomic DNA
ccagtgcagcaagtaggtggcaattatgtccacctacccttaagtccaagaacattaaatgcttgggtaaaattagtagaagagaaaaaatttggggcagaggtagtgccaggatttcaagcgctatcagaaggctgcactccctatgatattaatcaaatgctaaattgtgtaggagaacatcaggcagccatgcaaattattagagagattataaatgaagaagctgccgattgggatttacaacacccgcaaccaggtccactaccagcagggcaacttagagagccaagaggatcagacattgcaggaactactagtacagtagatgaacaaatccaatggatgtacaggcaacaaaaccccataccagtaggcaacatttatagaaggtggatccaattagggctgcagaaatgtgtaagaatgtataacccaacaaacattttagatgtgaaacaaggaccaaaagagccatttcaaagctacgtagatagattctacaaaagtctaagagcagagcaaacagatcccgcagtaaagaattggatgacccaaacactgctgattcaaaatgctaacccagattgtaaactagtgctcaagggtctgggcatgaatcccactttagaagaaatgctgacagcctgtcagggagtaggagggccaggacaaaaagctaggttaatg

SEQ ID NO: 886 - DNA, 426 bp, Simian immunodeficiency virus
  source 1..426: mol_type = genomic DNA
gcagaagcattgaaagaggcactgaggccagatcaactcccatttgcagcagtccaacagaaaggacaaaggaagacaatcaagtgttggaattgtggaaaggagggacactctgcaaaacaatgcagggcccctagaagacagggctgctggaagtgtggaaaaacgggtcatgttatggccaaatgccctgaaagacaggcgggttttttagggcttggcccatggggaaagaagccccgcaatttccccatggcccagatgcctcaggggctgataccaactgctcccccagaggatccagctgtggatctactgaagaattacatgaagatgggcagaaagcagagggagaacagagagagaccttacaaggaggtgacagaggatttgctgcacctcaattctctctttggagaagaccag

SEQ ID NO: 887 - DNA, 288 bp, Simian immunodeficiency virus
  source 1..288: mol_type = genomic DNA
tctctttggagaagaccagtagtcactgcctacattgaagaacagcccgtagaagtattattagatacaggggctgacgattcaattgtagcagggatagaattgggtccaaattatacccctaaaatagtaggaggaataggaggcttcattaacaccaaagaatataaagatgtaaaaataaaagtcttaggcaaggtaattaagggaacaattatgacgggagataccccaattaatatttttggcagaaatttgctaacagctatgggcatgtctttaaatctc

SEQ ID NO: 888 - DNA, 57 bp, Simian immunodeficiency virus
  source 1..57: mol_type = genomic DNA
cccatagctaaggtggagggtgccggcggcaactaccccgtgcagcaaggcggcagc

SEQ ID NO: 889 - DNA, 18 bp, Simian immunodeficiency virus
  source 1..18: mol_type = genomic DNA
ccagtgcagcaagtaggt

SEQ ID NO: 890 - DNA, 429 bp, unidentified
  misc_feature 1..429: note = Visna-maedi virus
  source 1..429: mol_type = genomic DNA
atggccaagcagggctccaaggagaagaagggctaccccgagctgaaggaagtgatcaaggcaacctgcaagatcagggtgggacctggcaaggagaccctgacagagggcaactgtctgtgggccctgaagacaatcgacttcatctttgaggatctgaagaccgagccatggaccatcacaaagatgtatacagtgtgggatcggctgaagggactgaccccagaggagacatccaagagagagttcgcctctctgcaggccaccctggcctgcatcatgtgctcccagatgggcatgaagcctgagacagtgcaggccgccaagggcatcatctctatgaaggagggcctgcacgagaataaggaggccaagggcgagaaggtggagcagctgtaccctaacctggagaagcacagggaggtgtat

SEQ ID NO: 891 - DNA, 660 bp, unidentified
  misc_feature 1..660: note = Visna-maedi virus
  source 1..660: mol_type = genomic DNA
ccaatcgtgaatctgcaggcaggaggccgcagctggaaggcagtggagtccgtggtgttccagcagctgcagaccgtggccatgcagcacggcctggtgtctgaggactttgagcggcagctggcctactatgccaccacatggacaagcaaggatatcctggaggtgctggccatgatgccaggcaacagagcccagaaggagctgatccagggcaagctgaatgaggaggcagagcggtgggtgagacagaacccacctggacccaatgtgctgaccgtggaccagatcatgggcgtgggccagacaaaccagcaggccagccaggccaatatggatcaggccaggcagatctgcctgcagtgggtcatcaccgccctgaggagcgtgcgccacatgtcccacaggcctggaaacccaatgctggtgaagcagaagaatacagagtcctacgaggacttcatcgccaggctgctggaggcaatcgacgcagagcccgtgacagatcctatcaagacctacctgaaggtgaccctgtcttatacaaacgccagcaccgactgccagaagcagatggataggaccctgggaacacgcgtgcagcaggcaaccgtggaggagaagatgcaggcctgtcgggatgtgggctctgagggcttt

SEQ ID NO: 892 - DNA, 237 bp, unidentified
  misc_feature 1..237: note = Visna-maedi virus
  source 1..237: mol_type = genomic DNA
aagatgcagctgctggcccaggccctgagacctcagggcaaggcaggacagaagggagtgaaccagaagtgctacaattgtggcaagccaggacacctggcaaggcagtgcagacagggaatcatctgccaccactgtggcaagaggggccacatgcagaaggactgtcgccagaagaagcagcagggcaacaataggagaggaccaagggtggtgccatctgccccaccaatgctg

SEQ ID NO: 893 - DNA, 312 bp, unidentified
  misc_feature 1..312: note = Visna-maedi virus
  source 1..312: mol_type = genomic DNA
gtgacagaggcccctcctaagatcgagatcaaggtgggcacaagatggaagaaactgctggtcgacaccggcgctgataagaccatcgtgaccagccacgacatgagcggcatccccaagggcagaatcatcctgcagggcattggaggaatcatcgagggcgagaagtgggagcaggtgcacctgcagtacaaggacaagatcatccggggcaccatcgtggtgctcgccacatctccagtggaagtgctgggaagagataacatgcgggaactgggcatcggcctgatcatggctaacctggaagagaaa

SEQ ID NO: 894 - DNA, 39 bp, unidentified
  misc_feature 1..39: note = Visna-maedi virus
  source 1..39: mol_type = genomic DNA
ggtgccagggaggtgtatccaatcgtgaatggcggcagc

SEQ ID NO: 895 - DNA, 18 bp, unidentified
  misc_feature 1..18: note = Visna-maedi virus
  source 1..18: mol_type = genomic DNA
ccaatcgtgaatctgcag

SEQ ID NO: 896 - DNA, 1632 bp, Bovine foamy virus
  source 1..1632: mol_type = genomic DNA
atggccctgaatgatttcgaccctatcgccctccagggctacctgccggcccctagagtgctgcaacacaacgacatcatcatctgcagagctacttctggcccctggggcatcggcgacagatacaacctgatcaggatccacctgcaagaccctgccggacagccccttccaatcccccagtgggagcctatccctaaccggaccgccaacccccggacacagccctaccctgtggtgtctgccccaatggctaccctggaaaacatcctgaacaactttcacatcccccacggcgtgtccagatacggccccctggaaggcggagattaccagcctggcgaacagtacagccaaggcttctgccctgtgacccaggccgagattgccctgctgaacggccagcacctggaagaagagatcacaatcctgagagagatcacccacagactgatgcagggcgtgcggcctcctgccgtgcctcagggccctgctcctcctcctcctccagctcagcctcctgctcccctgcctgctccaccaattgggcctccacctcccgctgcccctgcccccgccccaggccccatgcctgtgccccagcatctgcctattacacatatcagagccgtgatcggcgaaacccccgccaacatccgcgaggtgccactgtggctggctagagccgttcccgccctgcagggagtgtaccccgtccaggacgccgtgatgagaagccgcaccgtgaacgccctgaccgtgcggcaccctggactggccctggaacctctggagtgcggcagctggcaagagtgtctggccgccctgtggcagagaaccttcggcgccaccgccctgcacgccctgggcgataccctgggtcagatcgcaaacagcgacggcatcgtgatggctatcgagctgggcctgctcttttccgatgataactgggacctggtgtggggaatctgtagaagattcctgcccggccaggccgtctgcgtggccgtgcaggccagactggatcccctgcccgacaacgctacaagaatcgtgatgatcagccacatcatccgggacgtgtacgccatcctgggcctggaccctctgggcagacccatgcagcagacactgcctagacggaacaaccagcctcccagacagcagccacagagacggcagcagcctagaagaaccggcaaccaggaggaaagaggccagcggaaccggggccggcagaacgcccagacccctcggcaggagggcaacagactgcagaacagccagctgcctggccctcgcgactgccccaacaatagcaaccagcctcggtaccctctgcggccaaacccccagcagccccaaagatacggccaggagcagaatcgtggcaacaatcccaacccttacagacaacctacccctggcaatggaaatcaaaacagaaacttcagccgggggcctgccccagtcaatgagcagagcagaggcagaggaagatctagccagggtacaaataacaccggctcctctgctgtgcacagcgtgcggctgaccagcgccgcccctcctatacccccacaagatgccggcactccgcccacttcaagtggaaatcaagggcaatcatct

SEQ ID NO: 897 - DNA, 438 bp, Bovine foamy virus
  source 1..438: mol_type = genomic DNA
atgccggcactccgcccacttcaagtggaaatcaagggcaatcatcttaaaggctactgggacagcggcgccgagatcacatgcgtgcccgctatctacatcatcgaggaacaacctgttggcaagaagctgattacaaccatccacaacgagaaggaacatgatgtgtactacgtggaaatgaaaatcgagaagcggaaggtgcagtgtgaagtgatcgccaccgccctggattacgtgctggtggcccctgtggacatcccctggtataagcctggacctctggaactgaccatcaagatcgacgtcgagagccagaagcacaccctgatcacagagtccaccctctctccacagggccagatgagactgaagaaactgctggaccagtaccaggccctgtggcagtgctgggagaaccaggtgggccacagaaga

SEQ ID NO: 898 - DNA, 39 bp, Bovine foamy virus
  source 1..39: mol_type = genomic DNA
ggtgcctctgctgtgcacagcgtgcggctgggcggcagc

SEQ ID NO: 899 - DNA, 1929 bp, unidentified
  misc_feature 1..1929: note = Brown greater galago prosimian foamy virus
  source 1..1929: mol_type = genomic DNA
atgtctcagccctcggcttccggttcagctggcgctggtggagctcctcagcagccccctccaccgccacctcagcccggcccagcggctccagtgccacgagcacaaattggttatggtgacctggacgtacttttattacaacaggaatatcatttgatagatccaaatttacaggtacaacacttagacactttattagttagaatcacaggaggcaactggggaccaggtgaccgatttgctcgtattgaggttcttcttagggacaccctaggaccactccaacaacccaggtataggtatgcagcaatgcagcaagcagatctcaggaatgacatcatcctgcatctaaattatcaagatgcaattataatttttgatatgataataccatctgaaggagttcataggcatggacccatgttcgatggactttggattcatggagatgattactccatgaactttcagccaattacagcacatgaactgtatcttttgccacagcaagttctcacagaagaagtggaactgctgacggaagtgtgcaaccgaatggcagactggataagacggcatcgctgtggaggaggaagtggaagctcacaacccccgccgccgcctccacccgctgtgcctgtcttgccttcagcacctccggctagcagtttacccttaccaccacaaggatggggaatctccccaccagtagccacatccactccaggagcggcaggacatagctccagtgccggccctaatatttcccttggtggaacatatgttcctccaccggtagcaccaccagctccggtgatagggggacccggaggtcccggacagttgccagcaatggtgcaagtcctccccgctcagccagtagtaattcccatcaatgttatccgaagtgtttgtggagatactccatcaaacccacaggatattccattgtggatgggaagaattattccagccattgagggtgtgtttcctattgataatccaaatctacgaatgagagttgtgaatgccctgcttgccctacatccgggcttagcaataacagaacttaatgcccagacttggggacaagtcttggctgtgctccatatgcgagccttgggacacacagccctccatcagcttcctgcactcttggagactattgtcaagacagatggcatattgccagcatataatatgggtatggaagtaactcaacaagacttttcatacgtatggggaattttaagaacactacttccgggacaagcatttgtcctaagtatgcaaaatgaattagatagattacctgcggctcagagaccgggaatgtttcccggcctactgcagaggactctggacatactagggttaaattctcggggacaaaatattcaaaaaaccaatactcagcaacaagctccaaaaaggggtcagaaaccgaaacctcgacttcctcctgtgcataggcgacccgcaccatttacaccacctgctacccctagcccgcgacaacaagcttctgcttccccttcttcgcagggcgataaccgaagtcctcaaccccaagggcgtggtacttacggaccgtccagaggaggaggcagtgggcccagatataacttcaggccccgagtgcaaccacctgatcgatacggctttggaaggggacaagggggtcgcagttcaataggtgctcaagataatcaacagcctggtcaaggaggacaacgcactcaacaaacaaaccaaaaccgaaaccaaggcaacgccacgggaggaagaactcaacctcaaaatcgcactgtgaatactgtgcgtgtcacacagactaacccccaaggaggaagttcagtgtcaaacccagctgtgacaacttctcagaatacaggaacaggaagtgcaactcagagctcatcatct

SEQ ID NO: 900 - DNA, 429 bp, unidentified
  misc_feature 1..429: note = Brown greater galago prosimian foamy virus
  source 1..429: mol_type = genomic DNA
caacttctcagaatacaggaacaggaagtgcaactcagagctcatcatcttaaaggctttgtggacacaggcagcagcatcacctgcttccccaagtacaccctggtcgaggaagatcctatcggccagtacgacatcagcaccatccacggcacagtgtcccagcctgtgtactacatcaagttcaaggtgaacggcaagaaagtggaagccgaggtgaccgagtctccactggactacgtgatcctgtgtcctagcgacgtgccctggctgtctacaaagctggaactgacaattaagctgcctctgcaccagcagcaacaggagctgctgagcaagaccagagtgaatcaaaaacagctgcagaaactctttatccagtatgatgacctgtggcagaagtgggagaaccaggttggacaccggaag

SEQ ID NO: 901 - DNA, 39 bp, unidentified
  misc_feature 1..39: note = Brown greater galago prosimian foamy virus
  source 1..39: mol_type = genomic DNA
ggtgccagaacagtgaacaccgtgcgggtgggcggcagc

SEQ ID NO: 902 - DNA, 1944 bp, unidentified
  misc_feature 1..1944: note = Central chimpanzee simian foamy virus
  source 1..1944: mol_type = genomic DNA
atggcctctggcagcaacgtggaggaatacgagctggatgtggaagccctggtggtcatcctgcgggacagaaacatcggaagaaatcccctgcacggcgaaatcatcggcctgagactgaccgagggctggtggggccagatcgagagatttcagatggtgcggctgatcctgcaggacgacgacaacgagcccctgcagagaccccgctacgaggtgatccccagagccgtgaacccccacaccatgttcatgatcagcggccccctggctgaactgcagctggccttccaggacctggacctgcccgagggccctctgcggtttggcccgctggctaacggccactacgtgcagggggatccttacagcagcagctaccggcccgtgaccatggccgaaacagcccagatgaccagagatgagctggaagatatcctgaacacccaaagcgagatcgagatccagatgatcaacctgctggaactttatgaggtggaaaccagagccctgagaagacagctggccgagagaagcagcatcggccagggaggagtgagccccggcgctccaaggccgagacctccagttagcagcttcagcggcctgcctagcctgccttctatccccggcatccaccccagagccccttcccctcctcgcgctacaagcacccctggtaacatcccctggtccctgggagatgacagcccacctagctcgtcttttcctggccctagtcagcctagagtgtctttccaccctggcaatcctttcgtggaggacgagggacatagacctagatcccagagccgggaaagacggagaaacaatcctcctgcccctatccctagcgcccctccaatgatccaatacgtgcccgtgcctcctccacctcctgtcggaaccgtgatacctatccaacacatccggtccgtgaccggcgagcctccaaagaacccccgagaaatccccatctggctgggccggaatgcccctgctatcgacggcgttttccccgtgacgaccccagacctgcggtgcagaatcatcaacgccattctgggaggcaacctgggcctgagcctgacacctgccgactgtgtgacctgggactctgccgtgggcaccctgttcgtgcggacacacggacagttccctatgcaccagctgggcacagtgatccagggcatcgtgaaccaggagggcgtggctaccgcttatacactgggcatgatgctgagcggccagaattaccccctcgtgagcggcatcatcagaggctacctgcccggccaggccgtggtgaccgcccttcagcagcgcctggaccaggaggtggatgaccaggccagggctgaaaccttcatccagcacctgaacgctgtgtacgagatcctgggcctcaacgccagaggacaatctatcagagccagcgtgacaccgcaacctcggccaagccggggccgcggcagaggccagtctacacctagaccttcccagggccctgtgagttcaggacggggcagacagcggcctgccagcggccagtacgacagaggcagcaacaaccagaaccaagaccagggtaacaccagccagggcggctacaacctgagaccaagaacctaccagcctcagagatacggcggcggaagaggtcggagatggaacgagaacaccaacagccaggagagcagacccagcgatcagggctcccagacaccccggcctaaccaagctggcagcggcgtcagaggcaaccagagccagacccctagacccgccgccggcagaggaggcagaggcaatcagaatagaaaccagcggtctagcggagccggcgatagcagagccgtcaacacagtgacccagagtgccacgtcctccacagatgaatcctcttcagctgttgcaaccgcttccagcggagatcaaaggaac

SEQ ID NO: 903 - DNA, 447 bp, unidentified
  misc_feature 1..447: note = Central chimpanzee simian foamy virus
  source 1..447: mol_type = genomic DNA
atgaatcctcttcagctgttgcaaccgcttccagcggagatcaaaggaactaaactgttagcccattgggacagcggcgccaccattacatgcgtgcccgagtccttcctggaagatgagcagcctatcaaacagaccctgatcaagacaatccacggcgagaagcagcagaaagtgtactacctgacctttaagatcaagggaagaaaggtggaagctgaagtgatcgccagcccttacgagtacatcctgctgtctccaacagacgtgccttggctgacacagcaacctctgcagctgaccatcctggtccccctgcaggagtatcaggatagaatcctcaacaagaccgccctgcctgaggaacagaagcaaagactgaagaccctgttcgccaagtacgacaccctgtggcagcactgggagaaccaggtgggccaccggcgg

SEQ ID NO: 904 - DNA, 39 bp, unidentified
  misc_feature 1..39: note = Central chimpanzee simian foamy virus
  source 1..39: mol_type = genomic DNA
ggtgccagagccgtcaacacagtgacccagggcggcagc

SEQ ID NO: 905 - DNA, 1677 bp, Equine foamy virus
  source 1..1677: mol_type = genomic DNA
atggcccagaacgagacatttgatcctgtggccctgcagggctactaccctgctggcggcatcctggccgacaatgacattatcaacatcagattcaccagcggacagtggggcatcggcgatagatggctgcaggtgcggctgagactggtggaccctaatactggacagcctctggctcagcctgagtacgaggacacaggcctgcctgccgaaaacaggggtatcgtggtggccgtgtcccacaacgccgccagaaatatcttcaacaacgtgcagccagctggtggccccaacagacacggccctctgcacgacggccaatttcaagtgggcgacgatcccagcgagcacttcgtgcctattgaggaaaacctgatcccccaggagatcgtgaacctgggagcagctagaagagaagtgcggctgctgagagaaatgtgcgtgcggctgctgcacgtgagaagacagatgatgggcatgggcatgcctggcgctatccagcctcaaccgccagtgggccccctgcccgcccctgcccagccccctatccctggcccacctgtgcctccccccgtgcctccccccgcccctccagcccctgtcaacccccctgtccctccagtgcagcctatccaccacctgcctattacccacatccgggccgtgatcggcgagacacctgcccagatcagagatgtgcccctgtggctggcccagtccatccctgccctgaccggcgtttatcctgccatggacgccggaacactgacaagactggtgaacgcgatcaccgccagacaccccggactcgctcttggcatgaacgaggccggctcctggcacgaggccgttcatctgatctggcagaggaccttcggcgctacagccctccatgccttgtctgatgtgctgaagggcatcgcccagcggaacggcgtggtgatggccctggaaatgggcctgatgttcaccaacgacgactgggacctgacctggtctgtgatccggagatgtctgcctggacaagccagcgttgtgaccatccaggcccggctggatgccctgccaaacaaccaggccaggatcatccaggccggctttatcatcagagaggtgtacgaggtgctgggcctggacccactgggccggccactgaacttccctggaggcctgacccagcgagacaccgccgtgcccgtgaccagaggccggggccgcggaagaaccggccctagaagaggccctgtgctgcctgtcagcagcaaccagcgccggcaagaaaccgcaggcggcaaccagcctcagacccaaccccagcagcagaacacattcagcaatcagacaaatcagagaggaaaccagcggcagtggcaaaatagaggaaccgacagccagagacggtacttcttcagacccagaccaagccagcctcagcggtacggcagcaaccagggccctgacaaccctaatccctacagaggaagagatagcaccaatcaaagcggccaggagcggcagctgcctcagcagcaacagggctctagaaggggccctggcagaaacacaaacagcggcaacaacaccgtgcacaccgtgcggcaagtggaatcttctcagctacaacaaaatgcaagccctacagcctctccaagtacaaatcaagggcaacagcct

SEQ ID NO: 906 - DNA, 438 bp, Equine foamy virus
  source 1..438: mol_type = genomic DNA
atgcaagccctacagcctctccaagtacaaatcaagggcaacagccttaagggattttatgataccggcgccgagatcacctgcgtgccagccatcttcctgatcgaggaagagcctatcggcgagcggaccatccaaacaatccacggcatcacaaaggaaaaggtgtactacctgacctttaagatccagggcagaaagctggccgctgaagtgattggaacccagctggactacgtgatcatcgcccctagcgacatcccctggtacaagaaatacgagctggaactgacaattaaaatcgacatccagaaacagcaggagcagctgctgcacaccaccaacctctctagcgagggaaagaagtacctgaaggacctgttcatcaagtatgataatctgtggcagaagtgggaaaaccaggtcggccacagaaga

SEQ ID NO: 907 - DNA, 48 bp, Equine foamy virus
  source 1..48: mol_type = genomic DNA
ggtgccaacaccgtgcacaccgtgcggcaagtggaatctggcggcagc

SEQ ID NO: 908 - DNA, 1542 bp, Feline foamy virus
  source 1..1542: mol_type = genomic DNA
atggcccgggaactgaaccccctgcagctgcaacagctgtacatcaacaatggcctgcagcccaatcccggccacggagatatcatcgcagttagattcacaggcggcccttggggccccggagatagatgggccagagtgaccatccggctgcaggacaacaccggccagcctctgcaagtgcccggatacgacctggagcctggcatcatcaatctgcgggaagatatcctgatcgccggcccatacaacctcatcagaacagcttttctggacctggaacctgccagaggaccagagcggcacggcccgttcggcgacggcagactgcagcctggcgatggactgagcgagggatttcagcctatcaccgacgaggaaatccaggctgaagtgggcaccatcggcgccgcccgtaacgagatccggctgctgagagaagccttgcagagactccaggctggcggtgttggacggcctatccctggggccgtgctgcagcctcaacctgtgatcggacctgtgatccccatcaaccacctgagaagcgtgattggcaacacacctcctaaccccagagatgtggccctgtggttgggcagatctacagccgctatcgagggcgtgttccccatcgtggaccaggtgacccggatgagagtggtgaacgccctggtcgcctctcatcctggcctgaccctgacagagaacgaggccggcagctggaacgccgccatcagcgccctgtggcggaaggcccacggcgctgctgctcagcacgagctggccggagtgctgagcgacatcaacaagaaggaaggcatccagacagccttcaacctgggcatgcagttcaccgatggcaattggtccctggtgtggggaatcatcaggaccctgctgcccggccaggccctggtcacaaacgcccagagccagttcgacctgatgggcgacgacattcagcgggccgagaacttccccagagtgattaacaacctgtacaccatgctgggcctgaacatccacggccagagcatcagacctagagtgcagacccagcctctgcagaccagacctcggaaccctggcagaagccagcagggtcagctgaatcagcctcggcctcagaacagagccaaccagtcctacagaccccctcggcagcagcaacaacacagcgacgtgcctgagcagagggaccagagaggcccatctcaaccgcctagaggctctggcggaggctataacttcagaagaaatccccagcagcctcagcggtacggccaaggcccccccggcccaaacccttacagacggttcggcgacggcggcaatccccagcagcaaggcccgcctccaaatagaggccctgatcagggacctagaccaggcggcaaccctcgcggcggcggcagggggcagggcccccggaacggcggaggcagcgccgccgccgtgcacaccgtgaaagccagcgaaaacgaaactaaaaatggatctgctgaagccgttgacggtggaaagaaagggggtaaagat

SEQ ID NO: 909 - DNA, 438 bp, Feline foamy virus
  source 1..438: mol_type = genomic DNA
atggatctgctgaagccgttgacggtggaaagaaagggggtaaagattaaaggttactgggattctcaggccgacatcacctgcgtgccaaaggacctgctgcagggcgaggaacccgtgcggcagcagaatgtgaccaccatccacggcacccaggagggcgatgtctactacgtgaacctgaagatcgacggcagaagaatcaacaccgaggtgatcggcacaacactggactatgctatcatcacccctggcgacgtgccttggatcctgaagaaacctctggaactgacaattaagctggatctggaagagcaacaaggaaccctgctcaacaacagcatcctgagcaagaagggcaaggaagagctgaaacagctgttcgagaagtactccgccctgtggcagagctgggagaaccaggtgggacacagacgg

SEQ ID NO: 910 - DNA, 39 bp, Feline foamy virus
  source 1..39: mol_type = genomic DNA
ggtgccgccgccgtgcacaccgtgaaagccggcggcagc

SEQ ID NO: 911 - DNA, 1941 bp, unidentified
  misc_feature 1..1941: note = Rhesus simian foamy virus
  source 1..1941: mol_type = genomic DNA
atggccgctgtggaaggcgatctggacgtgcaagccctgaccgatctgttcaacaacctgggcatcaaccgggacccccggcaccgggaagtgatcgccctgcggatgacaggcggctggtggggccctgccaccagatacaacctgatcaccgtgctgctgcaggatgatcagggtcagcctcttcagcagccccggtggcgggccgagggccgggccgccaaccccgctgtgatgctgaccctggaagccccatggcaggacctgcggatggcctttgacaacgtcgacctggccgacgacacactgcggtttggccctctggctaacggcaattacatccccggcgacgagtacagcctggagttcatccctcccgccatgcaagagatcgcccaaatgcagagagatgagctggaaaacgtgctggacattgtgggccagatcacaatgcagatgagcgacctgatcggaatgcaggacgcccagatccggggcctggagggccaaatcagaggcctgagaggcaatctgcccgtggccggaacaccaccacctcctcctccaagcctggacctgcagcctgccgccgccagcagcccttacgtggcccctgcgtctagcgctcctgccgcacccgtggcctctgctgatctgggctggttcgccgggggaccttccccaggctctgtggaccctcggctggcccgggtcgcctacaaccccttcctgcccggacctagcgacggcagcggcgtggccccggtgcagccctccgcccctcctgccgccagccctctgctgcccctgccacctgctcagcctgtgcagccagtgatccagtacgtgcaccctcctcctatgaaccctgcccagcagattattcctatccagcacatcagagccgtgaccggcaacgcccccaccaaccctagagagatccctatgtggatcggcagaaacgccagcgccatcgagggcgtgttccccatgaccacccctgatctgaggtgtcgggtgatcaacgccctgctcggcggcaacctgggcctgaacctggaaccacagcactgcgtgacctgggccagcgcaatcgccaccctgtacgttagaacccacggcagctaccccatccaccagctggctgaagtgctgagaggcgtggctaatagcgagggagttgctgccgcttatcagctgggcatgatgctgacaaaccgggattacaacctgatctgggggatcatccgccctctgctgcccggccaggccgtcgtgaccgccatgcagcatagactggatcaggagatcaacgacgccgccagagtggcctctttcatcaatcacctgaacggcgtgtacgagctgctgggcttgaacgccagaggccagagcctgagaatccctgcctctggcggacagaccacggccggaaccagcgccggcagaggcacaagaggaagacgcagccagcaaggcacacctggcagacagagcagcggccagagccagcagcagggaagaagaagcagccagggccagagcagacagtcagactccagcgaccagaacgtgcagagacaatcccagggcggcaacggacggggaggctataatctgagacccaggacctaccagccccagagatacggcggaggcagaggcagaaggtggaacgaccagcctgccagatcagacaaccagcagcggtcccaatctcaacagcctcagtccgaggctagaggcgagcagagcagaaccagcggagccggcagaggacagggcggccgggggaatcaaaacagaaaccagagaagcgccggtggcaatgccgacagaacagtgaacaccgtgacaaccgccagcgcttctacaagcgcctcaggtcaagatggatcctctccagctcctccagcctctggaagcggaaatcaagggaac

SEQ ID NO: 912 - DNA, 447 bp, unidentified
  misc_feature 1..447: note = Rhesus simian foamy virus
  source 1..447: mol_type = genomic DNA
atggatcctctccagctcctccagcctctggaagcggaaatcaagggaactaaattaaaagcccactgggacagcggagccaccattacatgcatccccgaggcttttctggaagatgagcagcctatccaaacaatgctgatcaagaccatccacggcgagaagcagcagaacgtgtactacctgacattcaagatccagggcagaaaggtggaagccgaggtgctggcctctccttatgactacatcctgctcaatccttctgatgtgccatggctgatgaaaaagcctctgcaactgaccgtgctggtccccctgcaggactaccaggagcggctgctgaaacagaccaccctgcctaaggaacagaaggaccagctggaaaagctgttcctgaagtacgacgccctgtggcagcactgggagaaccaggtgggccacagaaga

SEQ ID NO: 913 - DNA, 39 bp, unidentified
  misc_feature 1..39: note = Rhesus simian foamy virus
  source 1..39: mol_type = genomic DNA
ggtgccagaacagtgaacaccgtgacaaccggcggcagc

SEQ ID NO: 914 - DNA, 1941 bp, unidentified
  misc_feature 1..1941: note = Simian foamy virus type 1
  source 1..1941: mol_type = genomic DNA
atggccgccatcgagggcgatctggacgtgcaggccctggctaacctgttcaacgacctgggcatcaacagaaaccccagacacagagaggtgattgccctgagaatgaccggcggctggtggggccccgctaccagatataatctggtgagcctgctgctgcaggacgaccagggccagcctctgccacagcccagatggcgggctgaaggcagagccgcaaaccccgccgtgatgttcaccctggaagccccctggcaggatctgagactggcctttgacaatatcgacgtgggcgagggcacactgagattcggcccacttgctaacggcaactacatccccggcgacgagttcagcctggagttcctgcctcctgccatgcaggagatcacacagatgcagagagatgagctggaggaagtgctggatgtggtgggccagatcacaatgcagatgaacgacctgatcggcatgcaggacgcccagatccggggactggaaggacaactgagaggactgagaggcaatctgccagtggccggcacacctccacctcctccacccagcctggacctgcagcctgctgccgccagcagcccctacgtggcccctgcaccttccgctcctgctgcctctgccgccgcagccgacctgggatggttcgccggaggccctggccctggatctctggacccccgcctcgcccgggtggcctacaacccctttctgcctggccctagcgacggcagcggtgccgctcccgcccagcctagcgctcctccggtggcctctcctctgccttctctgctgcctgcccagcccatgcaacctgtgatccagtacgtgcaccccccacctatcaatcctgctcaacaggtgatccctattcagcatatcagagccgtgaccggcaacgcccctagcaacccaagagaaatccctatgtggatcggaagaaacgccagcgccatcgagggcgtgttccccatccctacatctgacatccgttctagagtgatcaacgccctgctgggtagacagctgggcctgaacctggatcctcagcactgcatcacctgggccagcgcaatcgccactctgtacgtgcgcacccacggcagctaccctctgcaccagctggccgaggttctgcggagagtctccaacagcgaaggcgcggccgccgcctggcagctgggcatgatgctgaccaaccaggactacaacctcgtgtggggaatggtcagacccctgctgcccggccaggctgtggtcaccgccatgcagcaccggctggatcaggaggtttctgatgccgccagaatcgtgtccttcgtgaaccacctgaacgccgtgtacgagctgctgggcctgaatgccagaggccagaacctcagggtctccaccggcggccagaccaccgctagaacaagcgccggcagaggcgccagaggcagacggtcccagcaggggacccctggcaggcagtctagcggacaggcccctcctcaaggccggagaagcagccagggccagcagcctaggcagtctgagagcggcgaccagaacaaccagcggcagctccagggaggaaacaaccggggcggctataacctgcggcctcggacataccagcctcagcggtacgggggaggccggggccggagatggaacgatcagaccgccagagccgataaccagcagcggagccaatcccaacaacctcagagcgaggcccggggcgagcagagcagaaccagcggcgccggcagagaacagggcggcagaggcaatcaaaatcggaatcaaagatctgccggagaaaacaccgacagatccgtgaacaccgtgacagccaccagcgccagcatcagcgcctcaggtcaaaatggatcctctacaactcctccagcctctggaagcggaaatcaagggaac

SEQ ID NO: 915 - DNA, 447 bp, unidentified
  misc_feature 1..447: note = Simian foamy virus type 1
  source 1..447: mol_type = genomic DNA
atggatcctctacaactcctccagcctctggaagcggaaatcaagggaactaaattaaaagcccactgggatagcggagctacaatcacctgcgtgcccgaggcctttctggaagatgagagacctatccagaccatgctgatcaagaccatccacggcgagaagcagcaggacgtctactacctgaccttcaaggtgcagggcagaaaggtggaagccgaggtgctggcctctccttatgactacatcctgctcaaccccagcgacgtgccttggctgatgaaaaagcctctgcagctgacagtgctggtgccactgcacgagtaccaggagcggctgctgcaacaaaccgccctgcctaaggaacagaaagagctgctgcagaagctgttcctgaagtacgacgccctgtggcagcattgggaaaaccaggtgggccaccggaga

SEQ ID NO: 916 - DNA, 39 bp, unidentified
  misc_feature 1..39: note = Simian foamy virus type 1
  source 1..39: mol_type = genomic DNA
ggtgccagatccgtgaacaccgtgacagccggcggcagc

SEQ ID NO: 917 - DNA, 396 bp, Human Immunodeficiency virus type 1
  source 1..396: mol_type = genomic DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattac

SEQ ID NO: 918 - DNA, 693 bp, Human Immunodeficiency virus type 1
  source 1..693: mol_type = genomic DNA
cctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttg

SEQ ID NO: 919 - DNA, 42 bp, Human Immunodeficiency virus type 1
  source 1..42: mol_type = genomic DNA
gctgaagcaatgagccaagtaacaaatccagctaccataatg

SEQ ID NO: 920 - DNA, 164 bp, Human Immunodeficiency virus type 1
  source 1..164: mol_type = genomic DNA
atacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaa

SEQ ID NO: 921 - DNA, 48 bp, Human Immunodeficiency virus type 1
  source 1..48: mol_type = genomic DNA
tttttagggaagatctggccttcccacaagggaaggccagggaatttt

SEQ ID NO: 922 - DNA, 156 bp, Human Immunodeficiency virus type 1
  source 1..156: mol_type = genomic DNA
cttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaa

SEQ ID NO: 923 - DNA, 2931 bp, synthetic construct
  misc_feature 1..2931: note = CasX 488 variant
  source 1..2931: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 924 - DNA, 2931 bp, synthetic construct
  misc_feature 1..2931: note = CasX 491 variant
  source 1..2931: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 925 - DNA, 2934 bp, synthetic construct
  misc_feature 1..2934: note = CasX 515 variant
  source 1..2934: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 926 - DNA, 2934 bp, synthetic construct
  misc_feature 1..2934: note = CasX 527 variant
  source 1..2934: mol_type = other DNA
caagagatcaagagaatcaacaagatcagaaggagactggtcaaggacagcaacacaaagaaggccggcaagacacggggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 927 - DNA, 2934 bp, synthetic construct
  misc_feature 1..2934: note = CasX 535 variant
  source 1..2934: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctcttcccctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 928 - DNA, 2934 bp, synthetic construct
  misc_feature 1..2934: note = CasX 536 variant
  source 1..2934: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctacccctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 929 - DNA, 2934 bp, synthetic construct
  misc_feature 1..2934: note = CasX 537 variant
  source 1..2934: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctgcccctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 930 - DNA, 2934 bp, synthetic construct
  misc_feature 1..2934: note = CasX 583 variant
  source 1..2934: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattaagctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 931 - DNA, 2931 bp, synthetic construct
  misc_feature 1..2931: note = CasX 660 variant
  source 1..2931: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagccccgaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccaacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 932 - DNA, 2931 bp, synthetic construct
  misc_feature 1..2931: note = CasX 661 variant
  source 1..2931: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttcagcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 933 - DNA, 2931 bp, synthetic construct
  misc_feature 1..2931: note = CasX 662 variant
  source 1..2931: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaaaacgaccggaagaagggcaagaagttcgccagataccagttcggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttcagcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagaccctgctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 934 - DNA, 2931 bp, synthetic construct
  misc_feature 1..2931: note = CasX 663 variant
  source 1..2931: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagccccgaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccaacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 935 - DNA, 2931 bp, synthetic construct
  misc_feature 1..2931: note = CasX 664 variant
  source 1..2931: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagccccgaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaacccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 936 - DNA, 2937 bp, synthetic construct
  misc_feature 1..2937: note = CasX 668 variant
  source 1..2937: mol_type = other DNA
caagagatcaagagaatcaacaagatcagaaggagactggtcaaggacagcaacacaaagaaggccggcaagacacggggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctcttcccctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 937 - protein, 977 aa, synthetic construct; identical to SEQ ID NO: 186
  REGION 1..977: note = CasX 488 variant

SEQ ID NO: 938 - protein, 977 aa, synthetic construct; identical to SEQ ID NO: 189
  REGION 1..977: note = CasX 491 variant

SEQ ID NO: 939 - protein, 978 aa, synthetic construct; identical to SEQ ID NO: 196
  REGION 1..978: note = CasX 515 variant

SEQ ID NO: 940 - protein, 978 aa, synthetic construct; identical to SEQ ID NO: 207
  REGION 1..978: note = CasX 527 variant

SEQ ID NO: 941 - protein, 978 aa, synthetic construct; identical to SEQ ID NO: 215
  REGION 1..978: note = CasX 535 variant

SEQ ID NO: 942 - protein, 978 aa, synthetic construct; identical to SEQ ID NO: 216
  REGION 1..978: note = CasX 536 variant

SEQ ID NO: 943 - protein, 978 aa, synthetic construct; identical to SEQ ID NO: 217
  REGION 1..978: note = CasX 537 variant

SEQ ID NO: 944 - protein, 978 aa, synthetic construct; identical to SEQ ID NO: 262
  REGION 1..978: note = CasX 583 variant

SEQ ID NO: 945 - protein, 977 aa, synthetic construct; identical to SEQ ID NO: 339
  REGION 1..977: note = CasX 660 variant

SEQ ID NO: 946 - protein, 977 aa, synthetic construct; identical to SEQ ID NO: 340
  REGION 1..977: note = CasX 661 variant

SEQ ID NO: 947 - protein, 977 aa, synthetic construct; identical to SEQ ID NO: 341
  REGION 1..977: note = CasX 662 variant

SEQ ID NO: 948 - protein, 977 aa, synthetic construct; identical to SEQ ID NO: 342
  REGION 1..977: note = CasX 663 variant

SEQ ID NO: 949 - protein, 977 aa, synthetic construct; identical to SEQ ID NO: 343
  REGION 1..977: note = CasX 664 variant

SEQ ID NO: 950 - protein, 979 aa, synthetic construct; identical to SEQ ID NO: 347
  REGION 1..979: note = CasX 668 variant

SEQ ID NO: 951 - DNA, 22 bp, synthetic construct
  misc_feature 1..22: note = T7 promoter primer
  source 1..22: mol_type = other DNA
gaaattaatacgactcactata

SEQ ID NO: 952 - DNA, 87 bp, synthetic construct
  misc_feature 1..87: note = sg2 backbone fwd
  source 1..87: mol_type = other DNA
gaaattaatacgactcactataggtactggcgcttttatctcattactttgagagccatcaccagcgactatgtcgtatgggtaaag

SEQ ID NO: 953 - DNA, 78 bp, synthetic construct
  misc_feature 1..78: note = sg2 backbone rev
  source 1..78: mol_type = other DNA
ctttgatgcttcttatttatcggatttctctccgataaataagcgctttacccatacgacatagtcgctggtgatggc

SEQ ID NO: 954 - DNA, 53 bp, synthetic construct
  misc_feature 1..53: note = sg2.7.37 spacer primer
  source 1..53: mol_type = other DNA
ggagcgagacatctcggccctttgatgcttcttatttatcggatttctctccg

SEQ ID NO: 955 - DNA, 90 bp, synthetic construct
  misc_feature 1..90: note = sg32 backbone fwd
  source 1..90: mol_type = other DNA
gaaattaatacgactcactataggtactggcgcttttatctcattactttgagagccatcaccagcgactatgtcgtatgggtaaagcgc

SEQ ID NO: 956 - DNA, 46 bp, synthetic construct
  misc_feature 1..46: note = sg32 backbone rev
  source 1..46: mol_type = other DNA
ctttgatgcttccctccgaagagggcgctttacccatacgacatag

SEQ ID NO: 957 - DNA, 43 bp, synthetic construct
  misc_feature 1..43: note = sg32.7.37 spacer primer
  source 1..43: mol_type = other DNA
cggagcgagacatctcggccctttgatgcttccctccgaagag

SEQ ID NO: 958 - DNA, 90 bp, synthetic construct
  misc_feature 1..90: note = sg64 backbone fwd
  source 1..90: mol_type = other DNA
gaaattaatacgactcactataggtactggcgcctttatctcattactttgagagccatcaccagcgactatgtcgtatgggtaaagcgc

SEQ ID NO: 959 - DNA, 54 bp, synthetic construct
  misc_feature 1..54: note = sg64 backbone rev
  source 1..54: mol_type = other DNA
ctttgatgcttcttacggaccgaagtccgtaagcgctttacccatacgacatag

SEQ ID NO: 960 - DNA, 45 bp, synthetic construct
  misc_feature 1..45: note = sg64.7.37 spacer primer
  source 1..45: mol_type = other DNA
cggagcgagacatctcggccctttgatgcttcttacggaccgaag

SEQ ID NO: 961 - DNA, 87 bp, synthetic construct
  misc_feature 1..87: note = sg174 backbone fwd
  source 1..87: mol_type = other DNA
gaaattaatacgactcactataactggcgcttttatctgattactttgagagccatcaccagcgactatgtcgtagtgggtaaagct

SEQ ID NO: 962 - DNA, 50 bp, synthetic construct
  misc_feature 1..50: note = sg174 backbone rev
  source 1..50: mol_type = other DNA
ctttgatgctccctccgaagagggagctttacccactacgacatagtcgc

SEQ ID NO: 963 - DNA, 36 bp, synthetic construct
  misc_feature 1..36: note = sg174.7.37 spacer primer
  source 1..36: mol_type = other DNA
cggagcgagacatctcggccctttgatgctccctcc

SEQ ID NO: 964 - RNA, 130 nt, synthetic construct
  misc_feature 1..130: note = sgRNA
  source 1..130: mol_type = other RNA
ggtactggcgcttttatctcattactttgagagccatcaccagcgactatgtcgtatgggtaaagcgcttatttatcggagagaaatccgataaataagaagcatcaaagggccgagatgtctcgctccg

SEQ ID NO: 965 - RNA, 107 nt, synthetic construct
  misc_feature 1..107: note = sgRNA
  source 1..107: mol_type = other RNA
ggtactggcgcttttatctcattactttgagagccatcaccagcgactatgtcgtatgggtaaagcgccctcttcggagggaagcatcaaagggccgagatgtctcg

SEQ ID NO: 966 - RNA, 120 nt, synthetic construct
  misc_feature 1..120: note = sgRNA
  source 1..120: mol_type = other RNA
ggtactggcgcctttatctcattactttgagagccatcaccagcgactatgtcgtatgggtaaagcgcttacggacttcggtccgtaagaagcatcaaagggccgagatgtctcgctccg

SEQ ID NO: 967 - RNA, 109 nt, synthetic construct
  misc_feature 1..109: note = sgRNA
  source 1..109: mol_type = other RNA
actggcgcttttatctgattactttgagagccatcaccagcgactatgtcgtagtgggtaaagctccctcttcggagggagcatcaaagggccgagatgtctcgctccg

SEQ ID NO: 968 - DNA, 60 bp, synthetic construct
  misc_feature 1..60: note = cleavage assay oligo
  source 1..60: mol_type = other DNA
tgaagctgacagcattcgggccgagatgtctcgctccgtggccttagctgtgctcgcgct

SEQ ID NO: 969 - DNA, 60 bp, synthetic construct
  misc_feature 1..60: note = cleavage assay oligo
  source 1..60: mol_type = other DNA
agcgcgagcacagctaaggccacggagcgagacatctcggcccgaatgctgtcagcttca

SEQ ID NO: 970 - DNA, 60 bp, synthetic construct; identical to SEQ ID NO: 969
  misc_feature 1..60: note = cleavage assay substrate
  source 1..60: mol_type = other DNA

SEQ ID NO: 971 - DNA, 60 bp, synthetic construct; identical to SEQ ID NO: 968
  misc_feature 1..60: note = cleavage assay substrate
  source 1..60: mol_type = other DNA

SEQ ID NO: 972 - DNA, 60 bp, synthetic construct
  misc_feature 1..60: note = cleavage assay substrate
  source 1..60: mol_type = other DNA
agcgcgagcacagctaaggccacggagcgagacatctcggcccgagtgctgtcagcttca

SEQ ID NO: 973 - DNA, 60 bp, synthetic construct
  misc_feature 1..60: note = cleavage assay substrate
  source 1..60: mol_type = other DNA
tgaagctgacagcactcgggccgagatgtctcgctccgtggccttagctgtgctcgcgct

SEQ ID NO: 974 - DNA, 60 bp, synthetic construct
  misc_feature 1..60: note = cleavage assay substrate
  source 1..60: mol_type = other DNA
agcgcgagcacagctaaggccacggagcgagacatctcggcccgactgctgtcagcttca

SEQ ID NO: 975 - DNA, 60 bp, synthetic construct
  misc_feature 1..60: note = cleavage assay substrate
  source 1..60: mol_type = other DNA
tgaagctgacagcagtcgggccgagatgtctcgctccgtggccttagctgtgctcgcgct

SEQ ID NO: 976 - DNA, 60 bp, synthetic construct
  misc_feature 1..60: note = cleavage assay substrate
  source 1..60: mol_type = other DNA
agcgcgagcacagctaaggccacggagcgagacatctcggcccgattgctgtcagcttca

SEQ ID NO: 977 - DNA, 60 bp, synthetic construct
  misc_feature 1..60: note = cleavage assay substrate
  source 1..60: mol_type = other DNA
tgaagctgacagcaatcgggccgagatgtctcgctccgtggccttagctgtgctcgcgct

SEQ ID NO: 978 - DNA, 60 bp, synthetic construct; identical to SEQ ID NO: 969
  misc_feature 1..60: note = cleavage assay substrate
  source 1..60: mol_type = other DNA

SEQ ID NO: 979 - DNA, 60 bp, synthetic construct; identical to SEQ ID NO: 968
  misc_feature 1..60: note = cleavage assay substrate
  source 1..60: mol_type = other DNA

SEQ ID NO: 980 - DNA, 60 bp, synthetic construct; identical to SEQ ID NO: 972
  misc_feature 1..60: note = cleavage assay substrate
  source 1..60: mol_type = other DNA

SEQ ID NO: 981 - DNA, 60 bp, synthetic construct; identical to SEQ ID NO: 973
  misc_feature 1..60: note = cleavage assay substrate
  source 1..60: mol_type = other DNA

SEQ ID NO: 982 - DNA, 60 bp, synthetic construct; identical to SEQ ID NO: 974
  misc_feature 1..60: note = cleavage assay substrate
  source 1..60: mol_type = other DNA

SEQ ID NO: 983 - DNA, 60 bp, synthetic construct; identical to SEQ ID NO: 975
  misc_feature 1..60: note = cleavage assay substrate
  source 1..60: mol_type = other DNA

SEQ ID NO: 984 - DNA, 60 bp, synthetic construct; identical to SEQ ID NO: 976
  misc_feature 1..60: note = cleavage assay substrate
  source 1..60: mol_type = other DNA

SEQ ID NO: 985 - DNA, 60 bp, synthetic construct; identical to SEQ ID NO: 977
  misc_feature 1..60: note = cleavage assay substrate
  source 1..60: mol_type = other DNA

SEQ ID NO: 986 - DNA, 60 bp, synthetic construct
  misc_feature 1..60: note = cleavage assay substrate
  source 1..60: mol_type = other DNA
agcgcgagcacagctaaggccacggagcgagacatctcggcccaaatgctgtcagcttca

SEQ ID NO: 987 - DNA, 60 bp, synthetic construct
  misc_feature 1..60: note = cleavage assay substrate
  source 1..60: mol_type = other DNA
tgaagctgacagcatttgggccgagatgtctcgctccgtggccttagctgtgctcgcgct

SEQ ID NO: 988 - DNA, 60 bp, synthetic construct
  misc_feature 1..60: note = cleavage assay substrate
  source 1..60: mol_type = other DNA
agcgcgagcacagctaaggccacggagcgagacatctcggccctagtgctgtcagcttca

SEQ ID NO: 989 - DNA, 60 bp, synthetic construct
  misc_feature 1..60: note = cleavage assay substrate
  source 1..60: mol_type = other DNA
tgaagctgacagcacttgggccgagatgtctcgctccgtggccttagctgtgctcgcgct

SEQ ID NO: 990 - DNA, 60 bp, synthetic construct
  misc_feature 1..60: note = cleavage assay substrate
  source 1..60: mol_type = other DNA
agcgcgagcacagctaaggccacggagcgagacatctcggccctactgctgtcagcttca

SEQ ID NO: 991 - DNA, 60 bp, synthetic construct
  misc_feature 1..60: note = cleavage assay substrate
  source 1..60: mol_type = other DNA
tgaagctgacagcagttgggccgagatgtctcgctccgtggccttagctgtgctcgcgct

SEQ ID NO: 992 - DNA, 60 bp, synthetic construct
  misc_feature 1..60: note = cleavage assay substrate
  source 1..60: mol_type = other DNA
agcgcgagcacagctaaggccacggagcgagacatctcggccctattgctgtcagcttca

SEQ ID NO: 993 - DNA, 60 bp, synthetic construct
  misc_feature 1..60: note = cleavage assay substrate
  source 1..60: mol_type = other DNA
tgaagctgacagcaattgggccgagatgtctcgctccgtggccttagctgtgctcgcgct

SEQ ID NO: 994 - DNA, 20 bp, synthetic construct
  misc_feature 1..20: note = spacer
  source 1..20: mol_type = other DNA
ggccgagatgtctcgctccg

SEQ ID NO: 995 - DNA, 18 bp, synthetic construct
  misc_feature 1..18: note = spacer
  source 1..18: mol_type = other DNA
ggccgagatgtctcgctc

SEQ ID NO: 996 - DNA, 19 bp, synthetic construct
  misc_feature 1..19: note = spacer
  source 1..19: mol_type = other DNA
ggccgagatgtctcgctcc

SEQ ID NO: 997 - DNA, 87 bp, synthetic construct; identical to SEQ ID NO: 961
  misc_feature 1..87: note = scaffold template fwd primer
  source 1..87: mol_type = other DNA

SEQ ID NO: 998 - DNA, 50 bp, synthetic construct; identical to SEQ ID NO: 962
  misc_feature 1..50: note = scaffold template rev primer
  source 1..50: mol_type = other DNA

SEQ ID NO: 999 - DNA, 22 bp, synthetic construct
  misc_feature 1..22: note = primer
  source 1..22: mol_type = other DNA
gaaattaatacgactcactata

SEQ ID NO: 1000 - DNA, 36 bp, synthetic construct; identical to SEQ ID NO: 963
  misc_feature 1..36: note = primer
  source 1..36: mol_type = other DNA

SEQ ID NO: 1001 - DNA, 34 bp, synthetic construct
  misc_feature 1..34: note = primer
  source 1..34: mol_type = other DNA
gagcgagacatctcggccctttgatgctccctcc

SEQ ID NO: 1002 - DNA, 35 bp, synthetic construct
  misc_feature 1..35: note = primer
  source 1..35: mol_type = other DNA
ggagcgagacatctcggccctttgatgctccctcc

SEQ ID NO: 1003 - DNA, 1536 bp, synthetic construct
  misc_feature 1..1536: note = glycoprotein plasmid pGP2
  source 1..1536: mol_type = other DNA
atgaagtgccttttgtacttagcctttttattcattggggtgaattgcaagttcaccatagtttttccacacaaccaaaaaggaaactggaaaaatgttccttctaattaccattattgcccgtcaagctcagatttaaattggcataatgacttaataggcacagccttacaagtcaaaatgcccaagagtcacaaggctattcaagcagacggttggatgtgtcatgcttccaaatgggtcactacttgtgatttccgctggtatggaccgaagtatataacacattccatccgatccttcactccatctgtagaacaatgcaaggaaagcattgaacaaacgaaacaaggaacttggctgaatccaggcttccctcctcaaagttgtggatatgcaactgtgacggatgccgaagcagtgattgtccaggtgactcctcaccatgtgctggttgatgaatacacaggagaatgggttgattcacagttcatcaacggaaaatgcagcaattacatatgccccactgtccataactctacaacctggcattctgactataaggtcaaagggctatgtgattctaacctcatttccatggacatcaccttcttctcagaggacggagagctatcatccctgggaaaggagggcacagggttcagaagtaactactttgcttatgaaactggaggcaaggcctgcaaaatgcaatactgcaagcattggggagtcagactcccatcaggtgtctggttcgagatggctgataaggatctctttgctgcagccagattccctgaatgcccagaagggtcaagtatctctgctccatctcagacctcagtggatgtaagtctaattcaggacgttgagaggatcttggattattccctctgccaagaaacctggagcaaaatcagagcgggtcttccaatctctccagtggatctcagctatcttgctcctaaaaacccaggaaccggtcctgctttcaccataatcaatggtaccctaaaatactttgagaccagatacatcagagtcgatattgctgctccaatcctctcaagaatggtcggaatgatcagtggaactaccacagaaagggaactgtgggatgactgggcaccatatgaagacgtggaaattggacccaatggagttctgaggaccagttcaggatataagtttcctttatacatgattggacatggtatgttggactccgatcttcatcttagctcaaaggctcaggtgttcgaacatcctcacattcaagacgctgcttcgcaacttcctgatgatgagagtttattttttggtgatactgggctatccaaaaatccaatcgagcttgtagaaggttggttcagtagttggaaaagctctattgcctcttttttctttatcatagggttaatcattggactattcttggttctccgagttggtatccatctttgcattaaattaaagcacaccaagaaaagacagatttatacagacatagagatgaaccgacttggaaagtaa

SEQ ID NO: 1004 - DNA, 1575 bp, synthetic construct
  misc_feature 1..1575: note = glycoprotein plasmid
  source 1..1575: mol_type = other DNA
atggttcctcaggctctcctgtttgtaccccttctggtttttccattgtgttttgggaaattccctatttacacgataccagacaagcttggtccctggagtccgattgacatacatcacctcagctgcccaaacaatttggtagtggaggacgaaggatgcaccaacctgtcagggttctcctacatggaacttaaagttggatacatcttagccataaaagtgaacgggttcacttgcacaggcgttgtgacggaggctgaaacctacactaacttcgttggttatgtcacaaccacgttcaaaagaaagcatttccgcccaacaccagatgcatgtagagccgcgtacaactggaagatggccggtgaccccagatatgaagagtctctacacaatccgtaccctgactaccgctggcttcgaactgtaaaaaccaccaaggagtctctcgttatcatatctccaagtgtggcagatttggacccatatgacagatcccttcactcgagggtcttccctagcgggaagtgctcaggagtagcggtgtcttctacctactgctccactaaccacgattacaccatttggatgcccgagaatccgagactagggatgtcttgtgacatttttaccaatagtagagggaagagagcatccaaagggagtgagacttgcggctttgtagatgaaagaggcctatataagtctttaaaaggagcatgcaaactcaagttatgtggagttctaggacttagacttatggatggaacatgggtctcgatgcaaacatcaaatgaaaccaaatggtgccctcccgataagttggtgaacctgcacgactttcgctcagacgaaattgagcaccttgttgtagaggagttggtcaggaagagagaggagtgtctggatgcactagagtccatcatgacaaccaagtcagtgagtttcagacgtctcagtcatttaagaaaacttgtccctgggtttggaaaagcatataccatattcaacaagaccttgatggaagccgatgctcactacaagtcagtcagaacttggaatgagatcctcccttcaaaagggtgtttaagagttggggggaggtgtcatcctcatgtgaacggggtgtttttcaatggtataatattaggacctgacggcaatgtcttaatcccagagatgcaatcatccctcctccagcaacatatggagttgttggaatcctcggttatcccccttgtgcaccccctggcagacccgtctaccgttttcaaggacggtgacgaggctgaggattttgttgaagttcaccttcccgatgtgcacaatcaggtctcaggagttgacttgggtctcccgaactgggggaagtatgtattactgagtgcaggggccctgactgccttgatgttgataattttcctgatgacatgttgtagaagagtcaatcgatcagaacctacgcaacacaatctcagagggacagggagggaggtgtcagtcactccccaaagcgggaagatcatatcttcatgggaatcacacaagagtgggggtgagaccagactgtaa

SEQ ID NO: 1005 - DNA, 1611 bp, synthetic construct
  misc_feature 1..1611: note = glycoprotein plasmid
  source 1..1611: mol_type = other DNA
atgttcatgccttcttctttttcctacagctcctgggcaacgtgctggttattgtgctgtctcatcattttggcaaagaattcgcccttaggaaagatggttccgcaggttcttttgtttgtactccttctgggtttttcgttgtgtttcgggaagttccccatttacacgataccagacgaacttggtccctggagccctattgacatacaccatctcagctgtccaaataacctggttgtggaggatgaaggatgtaccaacctgtccgagttctcctacatggaactcaaagtgggatacatctcagccatcaaagtgaacgggttcacttgcacaggtgttgtgacagaggcagagacctacaccaactttgttggttatgtcacaaccacattcaagagaaagcatttccgccccaccccagacgcatgtagagccgcgtataactggaagatggccggtgaccccagatatgaagagtccctacacaatccataccccgactaccactggcttcgaactgtaagaaccaccaaagagtccctcattatcatatccccaagtgtgacagatttggacccatatgacaaatcccttcactcaagggtcttccctggcggaaagtgctcaggaataacggtgtcctctacctactgctcaactaaccatgattacaccatttggatgcccgagaatccgagaccaaggacaccttgtgacatttttaccaatagcagagggaagagagcatccaacgggaacaagacttgcggctttgtggatgaaagaggcctgtataagtctctaaaaggagcatgcaggctcaagttatgtggagttcttggacttagacttatggatggaacatgggtcgcgatgcaaacatcagatgagaccaaatggtgccctccagatcagttggtgaatttgcacgactttcgctcagacgagatcgagcatctcgttgtggaggagttagttaagaaaagagaggaatgtctggatgcattagagtccatcatgaccaccaagtcagtaagtttcagacgtctcagtcacctgagaaaacttgtcccagggtttggaaaagcatataccatattcaacaaaaccttgatggaggctgatgctcactacaagtcagtccggacctggaatgagatcatcccctcaaaagggtgtttgaaagttggaggaaggtgccatcctcatgtgaacggggtgtttttcaatggtataatattagggcctgacgaccatgtcctaatcccagagatgcaatcatccctcctccagcaacatatggagttgttggaatcttcagttatccccctgatgcaccccctggcagacccttctacagttttcaaagaaggtgatgaggctgaggattttgttgaagttcacctcgagaaaaatccaatcgagcttgtagaaggttggttcagtagttggaaaagctctattgcctcttttttctttatcatagggttaatcattggactattcttggttctccgagttggtatccatctttgcattaaattaaagcacaccaagaaaagacagatttatacagacatagagatgaaccgacttggaaagtaa

SEQ ID NO: 1006 - DNA, 2721 bp, synthetic construct
  misc_feature 1..2721: note = glycoprotein plasmid
  source 1..2721: mol_type = other DNA
gccaccatgaggcaaggtgcacctgccaggggtcggagatggtttgttgtatgggctctgctgggactgactttgggcgtgctcgttgcttccgcagcaccctcttctccaggaacacctggcgtggctgcagccacgcaagctgctaatggcgggccagctaccccagccccaccggcaccaggagctccacctactggcgatcccaagccaaagaagaataagaagccaaagccacctaaaccccctcgaccagctggtgataatgctacagtggctgcaggtcatgctacactcagagaacatcttagagatataaaagctgaaaatacagacgctaatttctatgtctgtcccccacctacaggtgcaaccgttgtccaatttgaacaacccaggagatgtcctacacgtccagaagggcagaattataccgaaggtatagccgttgtgtttaaagaaaatattgcaccatataaatttaaagcgacgatgtattataaggatgtgacagtcagccaagtatggtttgggcatcgatatagccaattcatgggcattttcgaagatagagcacctgtaccgtttgaagaagttatagataaaataaatgcaaaaggcgtgtgccgtagcacagcgaaatatgttcggaataatttggaaacaacggcattccatcgcgatgatcatgaaacagatatggaacttaagcccgcaaatgctgccacacgtacctctcgtgggtggcatactacagatctgaaatataatccatcacgagtcgaagcatttcatcgatatggaacaaccgtgaattgtattgtggaagaagttgatgccagaagtgtttatccttatgatgaattcgtcctcgcaacaggagatttcgtttatatgtcaccattctatggatatcgtgaaggtagtcatacagagcatacttcttatgcagcagataggtttaaacaagtggatggtttctatgctcgggatttgactacaaaagcaagagctacagcccccacaactcgaaatcttctgaccactcctaaatttactgtagcgtgggattgggtacccaaacgaccatccgtatgtactatgacaaaatggcaagaagtagatgaaatgcttcggtctgaatatggtggaagctttagattttcaagtgatgcaatctctactacatttacaactaatctcacagaatatcccctttcacgagtcgatttgggagattgtattggtaaagatgcgcgggatgcaatggatcggatatttgctcgtagatataatgccacacatataaaagttggacaaccacaatattatctcgcaaacggcgggttcctcattgcctatcaaccgctcctttctaatactcttgccgaactctatgtccgagagcatctgagggaacaatcacgtaaaccgccgaatccaacacctcctccgcctggagcatccgcgaatgcctctgtcgaacgtataaagacaacgtcttcaattgaatttgctagacttcaattcacctataatcatatccaaaggcacgttaatgacatgctgggtagagtcgcaattgcttggtgtgaattgcaaaaccatgaacttacgttgtggaatgaagcacgtaaattgaatccaaatgcaattgctagcgcgacggttggacgcagagtttccgcccgaatgctgggagatgttatggcagtttctacatgtgtccccgtggctgccgataatgtcatagtgcagaattcaatgagaatatctagccgacctggtgcatgttattctagaccactcgtgagtttccgctatgaggatcaagggcccctggttgaaggccaactcggagaaaataatgaattgcgcttgacaagggacgcaattgaaccatgtacagttggccatcgccggtattttacatttggcggcgggtatgtctactttgaggaatatgcctatagtcatcaactttctcgtgctgatattacaactgtgtcaacatttattgatctgaatattacgatgcttgaagaccacgaattcgtaccgttggaagtctatacacgccatgagataaaagattccgggcttttggattataccgaagtgcaacgacggaatcaactccatgatctccgattcgcggatattgataccgtaattcatgctgatgcaaatgctgctatgtttgctggacttggggcattctttgaaggaatgggcgatctcggaagagcagttgggaaagtcgttatgggaatagttggtggtgtcgttagtgcggtttcaggtgtcagcagctttatgagcaatccattcggcgccctcgcagttgggctcctggtgcttgctgggcttgctgctgctttctttgctttccggtatgtgatgaggcttcaatccaatccaatgaaagcactttatcccttgactactaaagaactgaagaatccgactaatcctgatgcttcaggagaaggggaagaaggcggggatttcgatgaagctaaactggcggaagcacgtgaaatgatccgttatatggcattggtcagcgctatggaaagaaccgagcataaagctaagaagaaaggaacttctgcccttctctctgctaaagttactgatatggtgatgagaaaacggcgtaatacaaattatactcaggtaccgaataaggatggcgatgcagatgaagatgatttgtta

SEQ ID NO: 1007 - DNA, 1185 bp, synthetic construct
  misc_feature 1..1185: note = glycoprotein plasmid
  source 1..1185: mol_type = other DNA
atggggggggctgccgccaggttgggggccgtgattttgtttgtcgtcatagtgggcctccatggggtccgcagcaaatatgccttggtggatgcctctctcaagatggccgaccccaatcgctttcgcggcaaagaccttccggtcctggaccagctgaccgaccctccgggggtccggcgcgtgtaccacatccaggcgggcctaccggacccgttccagccccccagcctcccgatcacggtttactacgccgtgttggagcgcgcctgccgcagcgtgctcctaaacgcaccgtcggaggccccccagattgtccgcggggcctccgaagacgtccggaaacaaccctacaacctgaccatcgcttggtttcggatgggaggcaactgtgctatccccatcacggtcatggagtacaccgaatgctcctacaacaagtctctgggggcctgtcccatccgaacgcagccccgctggaactactatgacagcttcagcgccgtcagcgaggataacctggggttcctgatgcacgcccccgcgtttgagaccgccggcacgtacctgcggctcgtgaagataaacgactggacggagattacacagtttatcctggagcaccgagccaagggctcctgtaagtacgccctcccgctgcgcatccccccgtcagcctgcctctccccccaggcctaccagcagggggtgacggtggacagcatcgggatgctgccccgcttcatccccgagaaccagcgcaccgtcgccgtatacagcttgaagatcgccgggtggcacgggcccaaggccccatacacgagcaccctgctgcccccggagctgtccgagacccccaacgccacgcagccagaactcgccccggaagaccccgaggattcggccctcttggaggaccccgtggggacggtggcgccgcaaatcccaccaaactggcacataccgtcgatccaggacgccgcgacgccttaccatcccccggccaccccgaacaacatgggcctgatcgccggcgcggtgggcggcagtctcctggcagccctggtcatttgcggaattgtgtactggatgcgccgccacactcaaaaagccccaaagcgcatacgcctcccccacatccgggaagacgaccagccgtcctcgcaccagcccttgttttactta

SEQ ID NO: 1008 - DNA, 2517 bp, synthetic construct
  misc_feature 1..2517: note = glycoprotein plasmid
  source 1..2517: mol_type = other DNA
atgggaaacggcttgtggtttgttggtgtgataatcctgggagtagcctggggccaagtacatgattggacagaacaaaccgatccttggttcctggacggacttgggatggatcggatgtattggcgagatacaaatactggaagactctggcttcctaatacaccagatcctcagaagccacccaggggcttccttgctccaccagatgagctcaatcttacaacagctagtctcccgctgctgagatggtatgaagaacggttctgcttcgtgctggtaacaaccgctgaattccctcgcgatccaggacaattgttgtatattcccaaaacatatcttctgggtcgaccacccaatgcctctctcccagcacctactacagtggaaccaacagctcaacccccgccgtccgtggctcctctgaaagggcttctgcataaccccgtagcatcagtcttgctccgcagtcgtgcgtgggtcacattcagcgctgtgcccgatcctgaagcactcacttttcccaggggcgataatgtcgccacagcatctcatccttctggaccacgcgacactccaccccctcgcccacctgtcggcgctcgcaggcatcccacaacagaacttgatattactcatcttcataatgcctcaactacatggctggctacaagagggcttctgcggagccccgggagatatgtctacttttctccctctgcttctacatggccagttggaatatggacaactggtgaacttgtccttggttgtgacgcagcacttgtcagggcccggtatggtcgcgagtttatgggactggtcatctcaatgcatgattcaccgccagtcgaggtcatggttgtgccggccggtcaaacactggaccgagtgggagatcctgcagatgaaaatccacctggcgccctgccaggcccacccggtggaccaaggtaccgcgtgttcgtgctcggttcactcacccgtgcagataatggtagcgccttggatgcactgagacgtgtcggtgggtatcctgaagaagggaccaattatgcacaatttctcagtagggcgtatgctgaattctttagcggagatgctggagctgaacaagggccacggccacccttgttttggcggctcactggactcctggccacctctggattcgcatttgtcaatgctgctcatgccaatggggctgtatgtctgtctgatctcttggggttccttgctcatagtcgagccctcgcaggcctggctgctcggggagctgccggttgcgcagccgacagtgtcttcttcaacgtttccgtgcttgacccgactgcaagacttcaactggaagcaagattgcaacatctcgttgcagaaatcttggaaagggagcaatccctggctctgcatgcactcggataccaactcgcatttgtacttgactccccttccgcctatgatgccgttgcaccttctgccgctcacctgattgatgcattgtacgcagaattcctcggcggaagggttcttactactccagtggtgcatagggccttgttctatgcttctgcggtattgagacaaccatttctggccggagtgcctagcgccgtccaaagggagcgagctaggagatcactcctgattgcctctgcactctgcacatctgatgtagcagccgccacaaatgctgatctgaggactgccctcgctagagctgatcatcaaaagacgcttttctggctccccgatcatttcagtccttgtgcagcgtcacttagattcgaccttgatgaatcagtcttcatattggatgcactcgcccaggcaactagatctgaaacacctgttgaggtgctcgctcaacaaacacatggtttggcttctacactcacaaggtgggcccattataatgcattgattcgggcttttgtgcccgaagcgtcccaccgatgtggcggacaatcagcaaatgtggaacccaggatattggtgcctattacgcataatgcttcttatgtggttacgcatagcccattgccacgcggcattgggtataaactgacgggtgtggatgttcgcagacctctgtttctgacttatctgacagcaacctgtgagggttctactcgcgacattgaaagcaaacgtctcgtaaggacgcagaatcaaagagatttgggtctggttggcgctgttttcatgaggtatactcccgcaggcgaagttatgagcgtcctgctcgtcgacaccgataatacccaacaacagattgcagcgggccccacagaaggggctccatcagtcttctccagcgatgttccttcaaccgcgctgctcctgttcccgaatggcacggttatccacctgttggcgttcgatacacaacctgtcgcagccatcgcaccgggattcttggctgcatccgccctcggggttgtgatgataacagcagctctcgcggggatactgaaagtgctgcgcaccagcgtgcccttcttctggcgacgagagtta

SEQ ID NO: 1009 - DNA, 682 bp, synthetic construct
  misc_feature 1..682: note = glycoprotein plasmid
  source 1..682: mol_type = other DNA
atggggattttgggttgggtcgggcttattgccgttggggttttgtgtgtgcgggggggcttgccttcaaccgaatatgttattcggagtcgggtggctcgagaggtgggggatatattaaaggtgccttgtgtgccgctcccgtctgacgatcttgattggcgttacgagaccccctcggctataaactatgctttgatagacggtatatttttgcgttatcactgtcccggattggacacggtcttgtgggataggcatgcccagaaggcatattgggttaacccctttttatttgtggcgggttttttggaggacttgagttaccccgcgtttcctgccaacacccaggaaacagaaacgcgcttggccctttataaagagatacgccaggcgctggacagtcgcaagcaggccgccagccacacacctgtgaaggctgggtgtgtgaactttgactattcgcgcacccgccgctgtgtagggcgacaggatttgggacctaccaacggaacgtctggacggaccccggttctgccgccggacgatgaagcgggcctgcagccgaagcccctcaccacgccgccgcccatcatcgccacgtcggaccccaccccgcgacgggacgccgccacaaaaagcagacgccgacgaccccactcccggcgcctcttataagatc

SEQ ID NO: 1010 - DNA, 1698 bp, synthetic construct
  misc_feature 1..1698: note = glycoprotein plasmid
  source 1..1698: mol_type = other DNA
atgaaactcccaacaggaatggtcattttatgtagcctaataatagttcgggcagggtttgacgacccccgcaaggctatcgcattagtacaaaaacaacatggtaaaccatgcgaatgcagcggagggcaggtatccgaggccccaccgaactccatccaacaggtaacttgcccaggcaagacggcctacttaatgaccaaccaaaaatggaaatgcagagtcactccaaaaaatctcacccctagcgggggagaactccagaactgcccctgtaacactttccaggactcgatgcacagttcttgttatactgaataccggcaatgcagggcgaataataagacatactacacggccaccttgcttaaaatacggtctgggagcctcaacgaggtacagatattacaaaaccccaatcagctcctacagtccccttgtaggggctctataaatcagcccgtttgctggagtgccacagcccccatccatatctccgatggtggaggacccctcgatactaagagagtgtggacagtccaaaaaaggctagaacaaattcataaggctatgcatcctgaacttcaataccaccccttagccctgcccaaagtcagagatgaccttagccttgatgcacggacttttgatatcctgaataccacttttaggttactccagatgtccaattttagccttgcccaagattgttggctctgtttaaaactaggtacccctacccctcttgcgatacccactccctctttaacctactccctagcagactccctagcgaatgcctcctgtcagattatacctcccctcttggttcaaccgatgcagttctccaactcgtcctgtttatcttcccctttcattaacgatacggaacaaatagacttaggtgcagtcacctttactaactgcacctctgtagccaatgtcagtagtcctttatgtgccctaaacgggtcagtcttcctctgtggaaataacatggcatacacctatttaccccaaaactggacaggactttgcgtccaagcctccctcctccccgacattgacatcatcccgggggatgagccagtccccattcctgccattgatcattatatacatagacctaaacgagctgtacagttcatccctttactagctggactgggaatcaccgcagcattcaccaccggagctacaggcctaggtgtctccgtcacccagtatacaaaattatcccatcagttaatatctgatgtccaagtcttatccggtaccatacaagatttacaagaccaggtagactcgttagctgaagtagttctccaaaataggaggggactggacctactaacggcagaacaaggaggaatttgtttagccttacaagaaaaatgctgtttttatgctaacaagtcaggaattgtgagaaacaaaataagaaccctacaagaagaattacaaaaacgcagggaaagcctggcatccaaccctctctggaccgggctgcagggctttcttccgtacctcctacctctcctgggacccctactcaccctcctactcatactaaccattgggccatgcgttttcagtcgcctcatggccttcattaatgatagacttaatgttgtacatgccatggtgctggcccagcaataccaagcactcaaagctgaggaagaagctcaggattta

SEQ ID NO: 1011 - DNA, 1743 bp, synthetic construct
  misc_feature 1..1743: note = glycoprotein plasmid
  source 1..1743: mol_type = other DNA
atgggttgctctttttctatcttcttacttgcccttctgtcgtgccttacagtgccagcgtctgcggtggaagttaggaacgtcagttctagctactatgccaccaatgattgctcgaacagcagcatcacctggcaactcaacaacgcagttctccaccttcctggatgcgtcccatgtgagaatgataacggcaccttgcactgctggatacaagtaacaccaaatgtggctgtgaaacaccgcggcgcgctcactcataacctgcggacgcacgtcgatatgatcgtaatggcagctacggtctgttcggccctgtatgtgggagacatgtgcggggccgtgatgattgtgtcgcaggctctcataatatcgccagaacgccacaacttcacccaagagtgcaactgttccatctaccaaggtcatatcactggccatcgcatggcatgggacatgatgctaaactggtcaccaactcttaccatgatccttgcttatgccgctcgtgttcccgagctagtccttgaagttgtctttggtggtcattggggtgtggtatttggcttggcctatttctccatgcagggagcgtgggccaaggtcattgccatcctccttcttgttgcgggagtggacgcagagactcataccaccggctcagctgcgggtcatgccgcaagggggtttgccaacctccttagtcctggttccaagcaaaaaataagtttgatcaataccaatggcagctggcacataaaccggaccgcccttaattgtaatgacagcttgcagacgggtttcctcgcttctttgttttacgtcaacaacttcaacagctctggctgccccgagcgcatgtcttcctgccgtgggctggacgatttccgcatcgggtggggaaccctggaatacgagaccaacgtcaccaacgaggaggacatgaggccgtactgctggcattaccctccgaagccttgcggcattatctcggctaggacagtttgcgggccggtctactgtttcactcctagccctgttgttgtgggtactactgacgagcagggcttgcccacctatagctggggggaaaatgagaccgatgtcttcctgttaaatagcacaagacccccgcaaggagcttggttcggctgcacttggatgaatgggactgggtttactaagacatgcggtgcaccaccttgccgcattaggagggatttcaacagcaccctcgatctactgtgccccacagactgctttagaaagcacccggacaccacctatctcaagtgtggagcagggccttggttaacccccagatgcctggtagactacccttatagattgtggcattatccgtgcaccgtaaattttaccatctttaaggtgcggatgtatgtggggggggtggagcatcgattgtcagcagcatgcaacttcacgcgcggggaccgctgcagattggaggacagagataggggtcagcagagcccactgctgcattccaccactgagtgggcggtattaccatgctctttctccgacttaccggcactgtccactggtctattgcacctccatcaaaatatcgtggacgtgcagtatctctatggacttactccggctatcacaaaatacatcgtgaagtgggagtgggtggttctcctctttttgctgttggcagacgccagggtctgtgcgtgcctttggatgctcatcatattgggccaagccgaagcg

SEQ ID NO: 1012 - DNA, 2028 bp, synthetic construct
  misc_feature 1..2028: note = glycoprotein plasmid
  source 1..2028: mol_type = other DNA
atgggcgttacaggaatattgcagttacctcgtgatcgattcaagaggacatcattctttctttgggtaattatccttttccaaagaacattttccatcccacttggagtcatccacaatagcacattacaggttagtgatgtcgacaaactagtttgtcgtgacaaactgtcatccacaaatcaattgagatcagttggactgaatctcgaagggaatggagtggcaactgacgtgccatctgcaactaaaagatggggcttcaggtccggtgtcccaccaaaggtggtcaattatgaagctggtgaatgggctgaaaactgctacaatcttgaaatcaaaaaacctgacgggagtgagtgtctaccagcagcgccagacgggattcggggcttcccccggtgccggtatgtgcacaaagtatcaggaacgggaccgtgtgccggagactttgccttccataaagagggtgctttcttcctgtatgatcgacttgcttccacagttatctaccgaggaacgactttcgctgaaggtgtcgttgcatttctgatactgccccaagctaagaaggacttcttcagctcacaccccttgagagagccggtcaatgcaacggaggacccgtctagtggctactattctaccacaattagatatcaggctaccggttttggaaccaatgagacagagtacttgttcgaggttgacaatttgacctacgtccaacttgaatcaagattcacaccacagtttctgctccagctgaatgagacaatatatacaagtgggaaaaggagcaataccacgggaaaactaatttggaaggtcaaccccgaaattgatacaacaatcggggagtgggccttctgggaaactaaaaaaaacctcactagaaaaattcgcagtgaagagttgtctttcacagttgtatcaaacggagccaaaaacatcagtggtcagagtccggcgcgaacttcttccgacccagggaccaacacaacaactgaagaccacaaaatcatggcttcagaaaattcctctgcaatggttcaagtgcacagtcaaggaagggaagctgcagtgtcgcatctaacaacccttgccacaatctccacgagtccccaatccctcacaaccaaaccaggtccggacaacagcacccataatacacccgtgtataaacttgacatctctgaggcaactcaagttgaacaacatcaccgcagaacagacaacgacagcacagcctccgacactccctctgccacgaccgcagccggacccccaaaagcagagaacaccaacacgagcaagagcactgacttcctggaccccgccaccacaacaagtccccaaaaccacagcgagaccgctggcaacaacaacactcatcaccaagataccggagaagagagtgccagcagcgggaagctaggcttaattaccaatactattgctggagtcgcaggactgatcacaggcgggagaagaactcgaagagaagcaattgtcaatgctcaacccaaatgcaaccctaatttacattactggactactcaggatgaaggtgctgcaatcggactggcctggataccatatttcgggccagcagccgagggaatttacatagaggggctaatgcacaatcaagatggtttaatctgtgggttgagacagctggccaacgagacgactcaagctcttcaactgttcctgagagccacaactgagctacgcaccttttcaatcctcaaccgtaaggcaattgatttcttgctgcagcgatggggcggcacatgccacattctgggaccggactgctgtatcgaaccacatgattggaccaagaacataacagacaaaattgatcagattattcatgattttgttgataaaacccttccggaccagggggacaatgacaattggtggacaggatggagacaatggataccggcaggtattggagttacaggcgttataattgcagttatcgctttattctgtatatgcaaatttgtcttt

SEQ ID NO: 1013 - DNA, 1569 bp, synthetic construct
  misc_feature 1..1569: note = glycoprotein plasmid
  source 1..1569: mol_type = other DNA
atgaatataccttgctttgttgtgattctcagcttagccactacacattctctgggagaattccccttgtacacaattcctgagaagatagagaaatggactcccatagacatgatccatctgagttgccccaacaacctattatctgaggaagaaggttgcaatgcagagtcatcctttacttactttgagctcaagagtggttacctagctcatcagaaggttccagggtttacctgtaccggggtcgtgaacgaggcagagacatatacaaacttcgtcgggtacgtcaccacaaccttcaaaaggaagcactttaggcctacagtagccgcctgtcgtgatgcctacaactggaaagtgtcaggagaccccaggtacgaagagtcactccacactccttatcctgacagcagttggttgaggactgtgactacaaccaaagaatcacttctcataatatcgcccagcatcgtggaaatggatatttacggcaggactctccattcccccatgtttccttcaggagtatgttccaacgtatatccctctgtcccatcctgtgagactaatcatgattacacattatggctgcctgaagatcctagtttgagtttggtctgtgatatctttacttccagcaacggaaagaaggccatgaacgggtcacgcatctgcggattcaaggatgaaaggggattctacagatctttaaagggcgcttgcaagctgacattgtgtggaagacctggaattaggttattcgacggaacttgggtctcttttacaaagccggacgtgcacgtatggtgcactcccaaccaattgatcaatatacacaatgacagactagatgagatagaacacctgatcgtggaagacatcataaagaaaagagaagagtgcttagacaccctggaaacaatacttatgtctcaatctgttagctttagaaggttgagccatttccgaaagttagttccaggatatgggaaggcctacactattttaaacggcagcctgatggaaacaaatgtctactacaaaagggtcgacaagtgggctgacatcttaccctctaagggatgtctgaaagtcgggcaacaatgcatggaacctgtcaaaggagtcctcttcaatgggattatcaagggcccggatggccaaattttgatccccgagatgcagtcagagcagctaaagcagcatatggacctgttgaaggcggctgtgtttcctctccgacaccctttaatcagccgggaggcagtctttaagaaagacggggatgccgatgattttgtggatctccatatgcctgatgtccacaagtctgtgtcagatgtcgacctgggtctgcctcattggggtttctggatgttgatcggggcaacaatagtagcatttgtggtcttggtatgtttactccgtgtatgttgtaagagagtgaggaggagaagatcaggacgtgcaactcaggagatccccctgagctttccctctgcccctgttcctcgagccaaagtggtgtcatcttgggagtcctataaagggcttccaggtacatta

SEQ ID NO: 1014 - DNA, 9586 bp, synthetic construct
  misc_feature 1..9586: note = pMRG103 GAG-CasX119-PR plasmid
  source 1..9586: mol_type = other DNA
gtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttgttgtgctgtctcatcattttggcaaagaattcgccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaatttttgactagcagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatgaagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1015 - DNA, 9586 bp, synthetic construct
  misc_feature 1..9586: note = pMRG103 Gag-CasX438-PR plasmid
  source 1..9586: mol_type = other DNA
gtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttgttgtgctgtctcatcattttggcaaagaattcgccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaatttttgactagcagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatgaagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1016 - DNA, 20 bp, synthetic construct
  misc_feature 1..20: note = spacer
  source 1..20: mol_type = other DNA
gtgtagtacaagagatagaa

SEQ ID NO: 1017 - DNA, 20 bp, synthetic construct
  misc_feature 1..20: note = spacer
  source 1..20: mol_type = other DNA
ggccgagatgtctcgctccg

SEQ ID NO: 1018 - DNA, 20 bp, synthetic construct
  misc_feature 1..20: note = spacer
  source 1..20: mol_type = other DNA
ctgcattctagttgtggttt

SEQ ID NO: 1019 - DNA, 20 bp, synthetic construct
  misc_feature 1..20: note = spacer
  source 1..20: mol_type = other DNA
cgagacgtaattacgtctcg

SEQ ID NO: 1020 - DNA, 109 bp, synthetic construct
  misc_feature 1..109: note = gRNA sequence
  source 1..109: mol_type = other DNA
actggcgcttttatctgattactttgagagccatcaccagcgactatgtcgtagtgggtaaagctccctcttcggagggagcatcaaagctgcattctagttgtggttt

SEQ ID NO: 1021 - DNA, 109 bp, synthetic construct
  misc_feature 1..109: note = gRNA sequence
  source 1..109: mol_type = other DNA
actggcgcttttatctgattactttgagagccatcaccagcgactatgtcgtagtgggtaaagctccctcttcggagggagcatcaaagcgagacgtaattacgtctcg

SEQ ID NO: 1022 - DNA, 4560 bp, synthetic construct
  misc_feature 1..4560: note = pXDP17 sequence
  source 1..4560: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgct

SEQ ID NO: 1023 - DNA, 4620 bp, synthetic construct
  misc_feature 1..4620: note = pXDP1 sequence
  source 1..4620: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccagtaaaattaaagccaggaatggatggcccaaaagttaaacaatggccattgacagaagaaaaaataaaagcattagtagaaatttgtacagaaatggaaaaggaaggaaaaatttcaaaaattgggcctgaaaatccatacaatactccagtatttgccataaagaaaaaagacagtactaaatggagaaaattagtagatttcagagaacttaataagagaactcaagatttctgggaagttcaattaggaataccacatcctgcagggttaaaacagaaaaaatcagtaacagtactggatgtgggcgatgcatatttttcagttcccttagataaagacttcaggaagtatactgcatttaccatacctagtataaacaatgagacaccagggattagatatcagtacaatgtgcttccacagggatggaaaggatcaccagcaatattccagtgtagcatgacaaaaatcttagagccttttagaaaacaaaatccagacatagtcatctatcaatacatggatgatttgtatgtaggatctgacttagaaatagggcagcatagaacaaaaatagaggaactgagacaacatctgttgaggtggggatttaccacaccagacaaaaaacatcagaaagaacctccattcctttggatgggttatgaactccatcctgataaatggacagtacagcctatagtgctgccagaaaaggacagctggactgtcaatgacatacagaaattagtgggaaaattgaattgggcaagtcagatttatgcagggattaaagtaaggcaattatgtaaacttcttaggggaaccaaagcactaacagaagtagtaccactaacagaagaagcagagctagaactggcagaaaacagggagattctaaaagaaccggtacatggagtgtattatgacccatcaaaagacttaatagcagaaatacagaagcaggggcaaggccaatggacatatcaaatttatcaagagccatttaaaaatctgaaaacaggaaagtatgcaagaatgaagggtgcccacactaatgatgtgaaacaattaacagaggcagtacaaaaaatagccacagaaagcatagtaatatggggaaagactcctaaatttaaattacccatacaaaaggaaacatgggaagcatggtggacagagtattggcaagccacctggattcctgagtgggagtttgtcaatacccctcccttagtgaagttatggtaccagttagagaaagaacccataataggagcagaaactttctatgtagatggggcagccaatagggaaactaaattaggaaaagcaggatatgtaactgacagaggaagacaaaaagttgtccccctaacggacacaacaaatcagaagactgagttacaagcaattcatctagctttgcaggattcgggattagaagtaaacatagtgacagactcacaatatgcattgggaatcattcaagcacaaccagataagagtgaatcagagttagtcagtcaaataatagagcagttaataaaaaaggaaaaagtctacctggcatgggtaccagcacacaaaggaattggaggaaatgaacaagtagataaattggtcagtgctggaatcaggaaagtactatttttagatggaatagataaggcccaagaagaacatgagaaatatcacagtaattggagagcaatggctagtgattttaacctaccacctgtagtagcaaaagaaatagtagccagctgtgataaatgtcagctaaaaggggaagccatgcatggacaagtagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaattctgcaacaactgctgtttatccatttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcatgacaaaagccttaggcatctcctatggcaggaagaagcggagacagcgacgaagagctcatcagaacagtcagactcatcaagcttctctatcaaagcagtaag

SEQ ID NO: 1024 - DNA, 4805 bp, synthetic construct
  misc_feature 1..4805: note = pXDP88 sequence
  source 1..4805: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaattttcccattagtcctattgagactgtaccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgct

SEQ ID NO: 1025 - DNA, 4869 bp, synthetic construct
  misc_feature 1..4869: note = pXDP22 sequence
  source 1..4869: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaatttt

SEQ ID NO: 1026 - DNA, 1503 bp, synthetic construct
  misc_feature 1..1503: note = pXDP3 sequence
  source 1..1503: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataa

SEQ ID NO: 1027 - DNA, 4338 bp, synthetic construct
  misc_feature 1..4338: note = pXDP23 sequence
  source 1..4338: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgct

SEQ ID NO: 1028 - DNA, 4395 bp, synthetic construct
  misc_feature 1..4395: note = pXDP24 sequence
  source 1..4395: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgct

SEQ ID NO: 1029 - DNA, 4814 bp, synthetic construct
  misc_feature 1..4814: note = pXDP25 sequence
  source 1..4814: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaatttcttagggaagaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgctagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaatttt

SEQ ID NO: 1030 - DNA, 4649 bp, synthetic construct
  misc_feature 1..4649: note = pXDP26 sequence
  source 1..4649: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgctagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaatttt

SEQ ID NO: 1031 - DNA, 4151 bp, synthetic construct
  misc_feature 1..4151: note = pXDP27 sequence
  source 1..4151: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgctgggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaatttt

SEQ ID NO: 1032 - DNA, 3926 bp, synthetic construct
  misc_feature 1..3926: note = pXDP28 sequence
  source 1..3926: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgctagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaatttt

SEQ ID NO: 1033 - DNA, 3759 bp, synthetic construct
  misc_feature 1..3759: note = pXDP29 sequence
  source 1..3759: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaatttt

SEQ ID NO: 1034 - DNA, 4482 bp, synthetic construct
  misc_feature 1..4482: note = pXDP30 sequence
  source 1..4482: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaatttt

SEQ ID NO: 1035 - DNA, 3450 bp, synthetic construct
  misc_feature 1..3450: note = pXDP31 sequence
  source 1..3450: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgct

SEQ ID NO: 1036 - DNA, 4173 bp, synthetic construct
  misc_feature 1..4173: note = pXDP32 sequence
  source 1..4173: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgct

SEQ ID NO: 1037 - DNA, 4395 bp, synthetic construct; identical to SEQ ID NO: 1028
  misc_feature 1..4395: note = pXDP24 sequence
  source 1..4395: mol_type = other DNA

SEQ ID NO: 1038 - DNA, 4649 bp, synthetic construct; identical to SEQ ID NO: 1030
  misc_feature 1..4649: note = pXDP26 sequence
  source 1..4649: mol_type = other DNA

SEQ ID NO: 1039 - DNA, 4151 bp, synthetic construct; identical to SEQ ID NO: 1031
  misc_feature 1..4151: note = pXDP27 sequence
  source 1..4151: mol_type = other DNA

SEQ ID NO: 1040 - DNA, 3926 bp, synthetic construct; identical to SEQ ID NO: 1032
  misc_feature 1..3926: note = pXDP28 sequence
  source 1..3926: mol_type = other DNA

SEQ ID NO: 1041 - DNA, 3759 bp, synthetic construct; identical to SEQ ID NO: 1033
  misc_feature 1..3759: note = pXDP29 sequence
  source 1..3759: mol_type = other DNA

SEQ ID NO: 1042 - DNA, 4356 bp, synthetic construct
  misc_feature 1..4356: note = pXDP98 sequence
  source 1..4356: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttgtttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1043 - DNA, 4677 bp, synthetic construct
  misc_feature 1..4677: note = pXDP99 sequence
  source 1..4677: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggctttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgccccaaagaagaagcggaaggtctctagatttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgct

SEQ ID NO: 1044 - DNA, 4764 bp, synthetic construct
  misc_feature 1..4764: note = pXDP100 sequence
  source 1..4764: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaatttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgct

SEQ ID NO: 1045 - DNA, 4398 bp, synthetic construct
  misc_feature 1..4398: note = pXDP101 sequence
  source 1..4398: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcatgcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgctggcggtggaagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaa

SEQ ID NO: 1046 - DNA, 4275 bp, synthetic construct
  misc_feature 1..4275: note = pXDP102 sequence
  source 1..4275: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 1047 - DNA, 4560 bp, synthetic construct; identical to SEQ ID NO: 1022
  misc_feature 1..4560: note = pXDP104 sequence
  source 1..4560: mol_type = other DNA

SEQ ID NO: 1048 - DNA, 2413 bp, synthetic construct
  misc_feature 1..2413: note = pStx42.174.12.7 plasmid sequence
  source 1..2413: mol_type = other DNA
gctagctaggtctagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaactacaaaaacaaattacaaaaattcaaaattttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagctgcattctagttgtggtttttttttttgaattc

SEQ ID NO: 1049 - DNA, 4530 bp, synthetic construct
  misc_feature 1..4530: note = pXDP64 sequence
  source 1..4530: mol_type = other DNA
atggaagccgtgatcaaggtgatcagctccgcatgcaagacctactgtggcaagacgagcccaagcaagaaggaaatcggcgctatgctgagcctgctgcagaaggagggcctcctgatgagcctgtctgatctgtacagcccaggtagctgggaccctatcaccgccgccctgacacagagagccatggtgctgggcaaaagcggcgagctgaagacatggggactggtgctgggcgccctgaaagccgctagagaagagcaagtaaccagcgagcaggccaagttctggctgggactgggcggcggtagagtgagcccccctggccctgagtgcatcgagaagcctgccaccgagcggcgcattgacaaaggcgaagaagtgggcgagacaaccgtgcagagagacgccaagatggctccagaagagacagcaaccccaaagaccgtgggcaccagctgctaccactgcggcaccgctatcggctgcaactgcgccaccgccagcgcgcctcctcccccgtatgtgggcagcggcctctacccctccctggcaggagtgggagagcagcagggccagggcggagatacacccagaggcgccgagcagcctagagccgaacccggccacgccggccaggcccctggccccgccctgaccgactgggccagaatcagagaggagctggcctctacaggccctccagtggtcgccatgcctgtggtgatcaagaccgagggacctgcctggacccctctggaacctaaactgattacacggctggctgataccgtcagaaccaagggcctcagaagccccatcacaatggccgaagtggaagccctgatgagcagcccactgctgcctcacgacgtgaccaacctgatgcgggtgatcctgggccccgccccttacgccctgtggatggacgcctggggcgtgcagctgcaaacagttatcgccgccgccacaagagacccccggcacccagccaacggccagggcagaggcgagagaacaaacctggatcggctgaagggcctcgccgatggcatggccggcaatcctgagggccaggctgctctgctgagacccggggaactggttgctatcaccgccagcgccctgcaggccttcagagaagtggcccggctggccgagcctacagacccctgggccgagatcacccagggcccttctgagagcttcgtggacttcgccaacagactgatcaaggccgttgagggctccgacctgcctcctagcgcccgcgcccccgtgatcatcgactgttttagacagaaatcgcaacccgacatccagcagctgatccgggccgctccttctaccctgaccacacctggcgagatcatcaagtacgtgctggacagacagaagaccgcccccctgaccgacagaggaatcgccgccgccatgtctagcgccattcagcctctggtgatggccgtggtcaacagagaaagagatggacagacaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1050 - DNA, 4527 bp, synthetic construct
  misc_feature 1..4527: note = pXDP65 sequence
  source 1..4527: mol_type = other DNA
atggaggccgtgatcaaggtgatcagcagcgcatgcaagacctactgcggcaagaccagcccatctaagaaagagatcggcgccatgctgagcctgctccaaaaggaaggcctgctgatgagcccttccgacctgtacagccccggaagctgggacccaatcaccgctgccctgacccagcgggccatggtgctgggaaagagcggcgagctgaagacctggggcctggtgctgggagccctgaaggccgccagagaggaacaagtgacaagcgaacaggccaagttctggctgggactgggcggaggaagagtcagccctcctggcccagagtgcatcgagaagcccgctacagagagaagaatcgataagggcgaagaggtgggcgagacaacagtgcagagagacgccaagatggctcctgaggaaaccgccacacctaagaccgtgggcacatcttgttaccactgcggcaccgccattggatgtaactgcgctacagccagcgcccccccccctccctacgtgggcagcggactttatcctagcctggccggcgtgggagagcagcagggccaaggcggagatacacccagaggcgccgagcagcctagagccgaacccggccacgccggactggcccctggcccagccctgaccgactgggcccgcatccgggaagaactggcttctaccggccccccggtggtcgccatgcctgtggttatcaagacagagggccctgcttggacccctctggaaccaaagctgattacaagactcgccgacaccgtgcggaccaagggcctgcggagccctatcaccatggccgagatggaagctctgatgagcagcccactgctgccccacgacgtgaccaacctgatgagagtgatcctgggccccgccccttacgccctgtggatggacgcctggggggtgcagctgcagaccgtgattgccgccgccaccagagatcctagacaccctgctaacggccaaggcagaggcgaaagaaccaaccttgacagactgaaaggcctggccgatggaatggtcggcaacagcgaaggccaggccgccctgctgagacctggcgagctggtggctatcacagccagcgccctgcaggccttcagagaagtggcccgactggctgagcccacggacccttgggccgacatcatgcagggcccttctgagagcttcgtggacttcgccaatagactgatcaaggccgtcgagggcagcgatcttcctcctagcgcgagagcccctgttatcatcgactgcttccggcagaaaagccagcccgacatccaacagctgatcagagccgccccttccaccctgaccacaccaggcgagatcatcaagtacgtgctggatagacagaagaccgcccctctgaccgatcagggcatcgccgctgccatgtcctctgccatccagcctctggtgatggccgtggtgaacagagagagagacggccagggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1051 - DNA, 4497 bp, synthetic construct
  misc_feature 1..4497: note = pXDP66 sequence
  source 1..4497: mol_type = other DNA
atgggccagacccacagcagacaactgttcgtgcacatgctgtccgtgatgctgaagcacagaggcatcaccgtgtctaagcctaagctgatcaacttcctgagcttcatcgaggaagtgtgtccttggtttccacgggaaggcacagtgaacctggaaacatggaaaaaggtgggcgaacagatcagaacccactacaccctgcacggccctgagaaggtgcctgtggaaacactttccttctggaccctgatccgcgactgcctggatttcgacaatgacgagctgaaaagactgggcaacctgctcaagcaggaggaagatcctctgcacgaccctgacagcgagaacagctacgacgcccctcctcctcctcatcctagcctgcactctagcagaccttccgacaacgacgacctgctgtctagcacagacgaggccgagctggacgaggaagccgccaagtaccaccaggaggactggggcttcctggctcaggagaaaggcgccctgacaagcaaggacgagctggtggaatgtttcaagaacctgaccatcgccctgcagaacgctggaatcaagctgccagccaacaacgataagttcccctccgccccccctctgcctcctgcctacgcccctagcgtggtggccggactggatccaccccccggccccctgcccccaagcaagaacatgtctccactgcagaaagccctgagacaagcccagaggctgggcgaagttgtgtccgatttcagcctggccttccccgtgttcgagaacaacaaccagcggtactacgagagcctgcctttcaagcagctgaaggaactcaaaatcgcatgcagccagtacggccctaccgcaccttttaccatcgccatgatcgagaacctcggcacccaggccctgccacctaatgattggaagcagacagccagagcctgcctgtcaggcggagattacctgctgtggaagagcgagttcttcgagcaatgcgccagaatcgctgacgtgaaccggcagcagggcatccagacgagctacgagatgctgatcggcgagggaccctaccaggccaccgacacccagctgaacttcctgcctggggcctatgcccaaatcagcaacgccgccagacaggcttggaagaaactgcctagctcttctacaaagaccgaggacctgagcaaagtgcggcaaggccccgatgagccctaccaggactttgtcgccagactgctcgacaccatcggcaagatcatgagcgacgaaaaggccggcatggtcctggctaagcaactggctttcgagaatgctaatagcgcctgtcaggccgccctgcggccttacagaaagaagggcgacctgtccgattttatcagaatctgcgccgacatcggcccctcttatatgcagggaattgccatggccgctgctctgcagggcaaaagcatcaagggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1052 - DNA, 4551 bp, synthetic construct
  misc_feature 1..4551: note = pXDP67 sequence
  source 1..4551: mol_type = other DNA
atgggcgtgtccggctcaaagggccagaagctgtttgtgtccgtgctgcagcgtctgctgtccgaacggggcctacacgtgaaagagagcagcgccatcgagttctaccagtttctgatcaaggtgtcaccctggttccccgaggaaggcggcctgaatctgcaggattggaagagagtgggcagagaaatgaagaagtacgccgctgagcacggcaccgacagcatccccaagcaggcttatcctatctggctgcaactgagagagatcctgacagagcaatctgacctggtgctgctgagcgccgaggccaagtccgtgacagaggaagaactggaagaaggcctgacaggactgctgagcgccagcagccaggagaagacctacggcacaagaggcaccgcctatgccgaaatcgacaccgaggtggataagctgagcgagcacatctacgacgagccctacgaggagaaggaaaaggccgacaagaacgaggagaaggaccacgtgcggaaggtcaagaagatcgtgcaaagaaaggaaaatagcgagcataagagaaaggagaaagatcagaaggccttcctggcaaccgactggaacaacgacgacctgagccctgaggactgggacgacctggaagagcaggccgcccactaccacgatgacgacgaactgatcctgcctgtgaagagaaaggtggacaagaagaagccgctcgccctgaggcggaaacctctgcccccggttggcttcgccggagccatggccgaggctagagagaagggcgatctgaccttcacatttcccgtggttttcatgggagaatccgacgacgatgatacccctgtgtgggaacctctgcccctgaagacactgaaggaactgcagtctgccgtgcggaccatgggccctagcgccccttacaccctccaggtggtggacatggttgcctctcagtggctgacacctagcgattggcaccaaaccgccagagccaccctgtctcctggggactacgtgctgtggcggaccgagtacgaggagaagagcaaggaaaccgtgcagaagaccgctggcaagcggaaaggcaaggtgagcctggatatgctgctgggcacaggtcagttcctgagcccttcttctcagatcaagctttctaaagatgtgctgaaggatgtgaccaccaacgccgtcctggcctggagagccatccctcctccaggcgtcaaaaagacagtgctggccggactcaagcagggaaatgaggaaagctacgagacattcatcagcagactggaagaggccgtgtacagaatgatgcctagaggagaaggcagcgacatcctgatcaagcagctggcttgggagaacgctaattctctgtgccaggacctgatccggcctatgcggaagaccggcaccatgcaggactacatcagagcctgtctggatgcctcccctgccgtggtgcagggcatggcctacgccgccgcaatgagaggacaaaagtacagcggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1053 - DNA, 4638 bp, synthetic construct
  misc_feature 1..4638: note = pXDP68 sequence
  source 1..4638: mol_type = other DNA
atgggccaggagctgtcccagcacgagcggtacgtggagcagctgaagcaagcccttaaaacaagaggcgtgaaggtgaaatacgccgacctgctgaagttcttcgattttgtgaaggatacctgcccttggttccctcaggagggcaccatcgacatcaagagatggcgcagagtgggcgactgcttccaagattactacaacaccttcggacctgagaaagtgcctgtgaccgccttcagctactggaacctgatcaaggaactgatcgacaaaaaggaagtgaacccacaggtgatggctgctgtcgcccagaccgaggaaatcctgaagagcaacagccagacagacctgaccaagaccagccagaaccctgacctggatctgatcagcctggacagcgatgatgagggcgccaagtccagcagcctgcaggacaagggcctgagcagcaccaaaaagcctaagcggttccccgtcctgctgaccgcccagacaagcaaggacccagaggatcctaacccaagcgaggtggactgggacggcctggaggacgaggccgctaagtaccacaaccctgactggccccccttcctgacaagacctccaccttacaacaaggctacccctagcgcccctaccgtgatggccgtggtgaaccctaaagaggaactgaaagaaaagatcgcccagctggaagagcagatcaaactggaagagctgcaccaggccctgatttctaagctgcaaaagctgaaaaccggcaacgagacagtcactcaccctgatacagccggaggcctgagcagaacaccacattggcccggccagcacatccctaagggcaagtgctgcgccagccgggaaaaggaagagcagatccccaaggatatcttccctgtgaccgaaaccgttgacggacagggccaggcatggagacaccacaatggcttcgacttcgccgtgatcaaggaactgaagacagccgcctctcaatacggcgccaccgcaccttacaccctggctatcgtggaatccgtcgccgacaactggctgaccccaaccgactggaataccctggtgcgggccgtgctgtctggcggcgaccacctgctctggaagtctgagttcttcgagaactgtagggacaccgctaagcggaaccagcaggccggcaatggatgggattttgacatgctgaccggcagcggcaactacagctctacagacgcccaaatgcagtacgaccctggcctgttcgcccagattcaggccgctgccacaaaggcctggcggaagctgcccgtgaagggggatcccggcgccagcctgaccggcgtgaagcagggccccgatgagcctttcgccgacttcgtgcatagactgatcaccacagccggcagaatcttcggctccgccgaagccggcgtggactacgtgaagcagctggcttacgagaacgccaaccctgcctgccaggccgcaatcagaccctatagaaagaagacagatctgaccggctacatccggctgtgcagcgacatcggcccttcctatcagcagggactggctatggccgctgcctttagcggccagaccgtgaagggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1054 - DNA, 4029 bp, synthetic construct
  misc_feature 1..4029: note = pXDP69 sequence
  source 1..4029: mol_type = other DNA
atgggcaactctcctagctacaatccccctgccggcatctccccatctgactggctgaacctgctgcagtccgcccagcgcctgaatccaaggcctagcccatccgacttcacagatctgaagaactatatccactggtttcacaagacccagaagaagccttggaccttcacaagcggaggaccaacatcctgcccaccaggcagatttggaagggtgccactggtgctggccaccctgaacgaggtgctgtccaatgagggaggagcacctggagcctctgccccagaggagcagcctccaccctacgaccctccagccatcctgcccatcatctccgagggaaacaggaataggcacagggcatgggcactgagggagctgcaggatatcaagaaggagatcgagaataaggcccctggctctcaagtgtggatccagacactgcggctggccatcctgcaggcagacccaacccctgcagatctggagcagctgtgccagtacatcgccagccctgtggaccagaccgcccacatgacatccctgaccgcagcaatcgcagcagcagaggcagcaacacccagcagagtgctgacccctaagaccggcacactgacccagcagtctgcccagccaaacgcaggcgatctgaggagccagtatcagaatctgtggctgcaggccggcaagatctccctgctggtgctgcagctgcagccctggtctaccatcgtgcagggacctgcagagagctccgtggagtttgtgaaccgcctgcagatctccctggccgacaacctgccagatggcgtgctgcggaatcccctgctgacacctctggtcatgcagatgctgaccgagtctgtgagcaagttctgcaggggagaggccagcggaaggggaggagccaagacagcaggactgagaaccatcggaccacctaggatgaagcagcctgccctgctggtgcacaccccaggaccaaagatgcctggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1055 - DNA, 4095 bp, synthetic construct
  misc_feature 1..4095: note = pXDP70 sequence
  source 1..4095: mol_type = other DNA
atgggtcagattttcagcagaagcgcctcccctattcctagacctccacggggcctggccgcccaccactggctgaatttcctgcaggccgcttatagactggagcctggaccttccagctacgacttccaccagctgaagaaattcctgaagatcgccctggaaacccctgccagaatctgccctatcaactacagcctgctggcctccctgctgcccaagggctaccctggcagagtgaacgagatccttcatatcctgatccagacacaggctcagatcccctctaggcccgctccacctcctccaagcagcccaacccacgatcctcctgatagcgaccctcagatccccccaccatacgtggagcccaccgcccctcaagtgctgccagtgatgcacccccacggcgcccctcctaatcacagaccttggcagatgaaagacctgcaggccatcaagcaggaagtgtcccaggccgctcctggcagcccccaatttatgcagaccatcagactcgccgttcagcagttcgaccccacagccaaggatctgcaggacctgctgcagtacctgtgtagcagcctggtcgccagcctgcaccatcagcaactggattctctgatcagcgaggccgagacaagaggcatcaccggctacaaccctctggccggccccctgcgggtgcaggcaaacaacccccagcagcaggggctgcggagagagtaccagcagctgtggctggctgctttcgccgcactgcctggaagcgccaaagatccatcttgggcctctatcctgcagggcctggaagaaccttaccacgcctttgtggaaagactgaacatcgccctggacaacggcctgcctgagggcacccctaaggaccccatcctgagatctctggcctacagcaacgccaacaaggaatgtcagaagctgctgcaagccagaggccacaccaacagccccctgggcgacatgctgcgcgcctgccagacctggacccctaaggacaagaccaaggtgctggtggtgcagcctaagaagcctccccctaatggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1056 - DNA, 4434 bp, synthetic construct
  misc_feature 1..4434: note = pXDP71 sequence
  source 1..4434: mol_type = other DNA
atgggcaatagctcctctaccccccctccaagcgccctgaagaactccgatctgttcaagaccatgctgaggacacagtacagcggctccgtgaagacacggagaatcaaccaggatatcaagaagcagtatccactgtggccagaccagggaacctgcgcaacaaagcactgggagcaggccgtgctgatccccctggactctgtgagcgaggagaccgccaaggtgctgaatttcctgcgggtgaagatccaggccagaaagggagagaccgcaaggcagatgaccgcacacacaatcaagaagctgatcgtgggcacaatcgataagaacaagcagcagaccgagatcctgcagaagacagacgagagcgatgaggagatggacaccacaaataccatgctgtttatcgcccgcaacaagagggagaggatcgcacagcagcagcaggcagatctggcagcacagcagcaggtgctgctgctgcagagggagcagcagagggagcagagagagaaggatatcaagaagcgggacgagaagaagaagaagctgctgcccgacaccacacagaaggtggagcagaccgatatcggagaggccagctcctctgacgcctccgcccagaagccaatctctaccgacaacaatcccgatctgaaggtggacggcgtgctgacaagaagccagcacaccacagtgccttccaacatcaccatcaagaaggatggcacatccgtgcagtaccagcaccccatcaggaactatcctaccggcgagggcaatctgacagcccaggtgcggaacccttttagaccactggagctgcagcagctgaggaaggactgccccgccctgcctgagggcatcccacagctggccgagtggctgacccagacaatggccatctacaattgtgacgaggccgatgtggagcagctggccagagtgatcttcccaacccctgtgaggcagatcgcaggcgtgatcaacggacacgcagcagcaaataccgcagccaagatccagaactacgtgacagcatgcaggcagcactatccagccgtgtgcgattggggcaccatccaggcctttacatacaagccccctcagaccgcccacgagtatgtgaagcacgccgagatcatcttcaagaacaatagcggactggagtggcagcacgcaaccgtgccttttatcaatatggtggtgcagggcctgccacccaaggtgacacggtccctgatgtctggcaacccagattggagcaccaagacaatcccacagatcatccccctgatgcagcactacctgaatctgcagtccagacaggacgccaagatcaagcagacccctctggtgctgcagctggccatgccagcccagacaatgaacggcaatggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1057 - DNA, 4398 bp, synthetic construct
  misc_feature 1..4398: note = pXDP72 sequence
  source 1..4398: mol_type = other DNA
atgggccagacaatcacaacccctctgagcctgaccctggaccactggagtgaagtgcgggctagagcccacaaccagggcgtggaagtccggaaaaaaaagtggatcaccctgtgcgaggccgagtgggtcatgatgaacgtgggatggcctagagagggtacatttagcctggacaacatcagccaggttgagaaaaagattttcgctcctggcccttacggccatcctgaccaggtgccttacatcaccacatggcggagcctggctaccgacccaccaagctgggtgcggcccttcctgcctcctcccaagccccccacccctctgcctcagcctctgagcccccagccctctgcccctctgaccagctctctgtaccctgtgctgcctaagtccgatccccctaaacctcctgttttacctcccgaccctagcagcccactgatcgacctgctgacggaagaacctcctccttatcctggcggacatggccccccaccttctggccctcggaccccaaccgcctcccctatcgcctctagactgagagagcggagagaaaaccccgccgaagagtcccaagccctgcccctgagagagggccctaacaaccggcctcagtactggcccttcagcgccagcgatctgtataactggaagtcccacaatcctcctttcagccaggatcctgtggccctgacaaacctgatcgagtctatcctggtgactcaccagccaacctgggatgactgccagcagctgctgcaggccctcctgaccggcgaagagagacagagagtgctgctggaggccagaaagcaggtgcctggagaggacggcaggcctacccagctgcctaatgtgatcgacgagacattccccctgaccagaccaaattgggacttcgccaccccagctggcagagagcacctgcgcctgtaccggcagcttctgctggccggactgagaggcgctgccagaagaccaaccaacctggctcaggtgaagcaggtcgtgcagggcaaagaggagacacccgccgctttcctggaacggctgaaggaggcctacagaatgtacaccccttacgaccccgaagatccaggacaggccgccagcgtgatcctgagcttcatctaccagagcagccctgacatcagaaacaagctgcagcggctggaaggcctgcagggcttcacactgagcgacctgctcaaggaggccgagaagatctacaacaagcgggaaacccctgaggaaagagaagagagattgtggcagcggcaagaggagcgggacaaaaagcggcacaaggaaatgaccaaggtgctggctaccgtggtggcccagaacagagataaaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1058 - DNA, 4497 bp, synthetic construct
  misc_feature 1..4497: note = pXDP73 sequence
  source 1..4497: mol_type = other DNA
atgggccagaccgtgaccacacccctgtccctgacactgggccactggaaggacgtggagcggatcgcccacaatcagtctgtggatgtgaagaagcggagatgggtgaccttctgcagcgccgagtggcccaccttcaacgtgggctggccaagggacggcaccttcaaccgcgatctgatcacacaggtgaagatcaaggtgtttagcccaggacctcacggacacccagaccaggtgccttatatcgtgacctgggaggccctggccttcgatccacctccatgggtgaagccatttgtgcacccaaagccacctccaccactgcctccatccgccccttctctgccactggagccacctcggtccaccccaccaagaagctccctgtatcctgccctgacaccatctctgggcgccaagccaaagccacaggtgctgtctgacagcggaggacctctgatcgacctgctgaccgaggatcctccaccctacagagatccaaggcctccaccatccgacagggatggaaacggaggagaggcaacaccagcaggagaggcccctgacccatcccccatggcctctagactgaggggcaggcgcgagcctccagtggcagatagcaccacatcccaggcattcccactgagggcaggaggaaatggccagctgcagtattggcccttttctagctccgacctgtacaactggaagaacaataacccatccttctctgaggatcccggcaagctgaccgccctgatcgagagcgtgctgatcacccaccagcccacatgggacgattgtcagcagctgctgggcaccctgctgacaggcgaggagaagcagcgggtgctgctggaggcaaggaaggccgtgagaggcgacgatggcagacccacccagctgcctaatgaggtggacgcagcatttccactggagaggccagactgggattataccacacaggccggcaggaaccacctggtgcactacaggcagctgctgctggccggactgcagaatgcaggcaggtcccctaccaacctggccaaggtgaagggcatcacacagggccctaatgagagcccatccgcctttctggagcgcctgaaggaggcctaccggagatataccccctacgaccctgaggatccaggccaggagacaaacgtgtctatgagcttcatctggcagtctgccccagacatcggaaggaagctggagcgcctggaggacctgaagaataagaccctgggcgatctggtgcgggaggcagagaagatcttcaacaagagagagacacctgaggagagggaggagcggatcaggagggagaccgaggagaaggaggagcggagaaggacagaggacgagcagaaggagaaggagcgggatcgccggagacacagagagatgagcaagctgctggccaccgtggtgtccggacagaagcaggacggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1059 - DNA, 4158 bp, synthetic construct
  misc_feature 1..4158: note = pXDP74 sequence
  source 1..4158: mol_type = other DNA
atggtgtctctggacagggatatggcaaggcaggtgagcggaggcaagagggattacccagagctggagaagtgcatcaagcacgcctgtaagatcaaggtgcggctgagaggagagcacctgaccgagggcaactgcctgtggtgtctgaagacactggactatatgttcgaggatcacaaggaggagccctggaccaaggtgaagtttagaacaatctggcagaaggtgaagaacctgacccctgaggagagcaataagaaggacttcatgtccctgcaggccacactggccggcctgatgtgctgtcagatgggcatgaggccagagaccctgcaggacgccatggccacagtgatcatgaaggatggcctgctggagcaggaggagaagaaggaggataagcgcgagaaggaggagagcgtgtttccaatcgtggtgcaggcagcaggaggccggtcctggaaggccgtggactctgtgatgttccagcagctgcagaccgtggcaatgcagcacggactggtgagcgaggattttgagagacagctggcctactatgccaccacatggacatccaaggacatcctggaggtgctggccatgatgcccggcaacagagcccagaaggagctgatccagggcaagctgaatgaggaggccgagaggtggcggagaaacaatccacctccaccagcaggaggaggactgaccgtggatcagatcatgggagtgggacagacaaaccaggcagcagcacaggcaaatatggaccaggccagacagatctgcctgcagtgggtcatcaacgcactgagggccgtgagacacatggcacacaggcccggcaaccctatgctggtgaagcagaagaccaatgagccttacgaggacttcgccgccagactgctggaggccatcgatgccgagccagtgacacagcccatcaaggactacctgaagctgaccctgagctatacaaatgcctccgccgactgccagaagcagatggatagaaccctgggacagagggtgcagcaggcctccgtggaggagaagatgcaggcctgtagggatgtgggctctgagggctttaagatgcagctgctggcccaggccctgaggggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1060 - DNA, 4140 bp, synthetic construct
  misc_feature 1..4140: note = pXDP75 sequence
  source 1..4140: mol_type = other DNA
atgggcgatcctctgacatggagcaaggccctgaagaagctggagaaggtgaccgtgcagggcagccagaagctgaccacaggcaactgcaattgggccctgtccctggtggacctgttccacgatacaaactttgtgaaggagaaggattggcagctgcgcgacgtgatcccactgctggaggacgtgacccagacactgtctggccaggagcgggaggccttcgagagaacctggtgggccatcagcgccgtgaagatgggcctgcagatcaacaatgtggtggatggcaaggcctcttttcagctgctgagggccaagtacgagaagaagacagccaacaagaagcagtctgagcctagcgaggagtatccaatcatgatcgacggcgccggcaaccggaatttcagaccactgacccccagaggctacaccacatgggtgaacacaatccagaccaacggcctgctgaatgaggcctcccagaatctgttcggcatcctgagcgtggattgtacctccgaggagatgaatgcctttctggacgtggtgccaggacaggcaggacagaagcagatcctgctggacgccatcgataagatcgccgacgattgggataaccggcacccactgcccaatgcacctctggtggcaccacctcagggacctatcccaatgacagccaggtttatcaggggactgggagtgccacgggagagacagatggagcccgccttcgaccagtttaggcagacctaccgccagtggatcatcgaggccatgagcgagggcatcaaagtgatgatcggcaagccaaaggcacagaacatcaggcagggagccaaggagccctatcctgagttcgtggatagactgctgtcccagatcaagtctgagggccaccctcaggagatctccaagtttctgaccgacacactgaccatccagaacgccaatgaggagtgccggaatgccatgcggcacctgagaccagaggataccctggaggagaagatgtacgcctgtagagacatcggcaccacaaagcagaagatgatgctgctggccaaggccctgcagacaggcctggccggaccattcaagggaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1061 - DNA, 4158 bp, synthetic construct
  misc_feature 1..4158: note = pXDP76 sequence
  source 1..4158: mol_type = other DNA
atgggcgccaggaacagcgtgctgtccggcaaggaggccgatgagctggagaaggtgcggctgagacccaatggcaagaagaagtacatgctgaagcacgtggtgtgggcagcaaacgagctggaccgcttcggcctggccgagtctctgctggataataaggagggctgccagaagatcctgagcgtgctggcccctctggtgccaaccggctctgagaacctgaagagcctgtataatacagtgtgcgtgatctggtgtatccacgccgaggagaaggtgaagcacaccgaggaggccaagcagatcgtgcagaggcacctggtggtggagaccggcacagcagataggatgccagccaccagccgcccaacagcaccaccttccggaaggggcggcaactaccccgtgcagcaagtgggcggcaattatgtgcacctgcccctgagccctagaaccctgaacgcctgggtgaagctggtggaggagaagaagttcggagcagaggtggtgccaggatttcaggccctgtccgagggctgcacaccctacgacatcaaccagatgctgaattgcgtgggagagcaccaggcagcaatgcagatcatccgggagatcatcaacgaggaggcagcagactgggatctgcagcaccctcagccaggaccactgcctgcaggacagctgcgggagcctagaggctctgacatcgccggcaccacaagcaccgtggatgagcagatccagtggatgtacaggcagcagaacccaatccccgtgggcaatatctatcggagatggatccagctgggcctgcagaagtgcgtgcggatgtataacccaaccaatatcctggacgtgaagcagggcccaaaggagcccttccagagctacgtggacagattctacaagtccctgagagccgagcagacagatcccgccgtgaagaactggatgacccagacactgctgatccagaacgccaatcccgattgcaagctggtgctgaagggcctgggcatgaatcctaccctggaggagatgctgacagcatgtcagggagtgggaggacctggacagaaggcaaggctgatggcagaggccctgaaggaggccctgaggcctggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1062 - DNA, 4152 bp, synthetic construct
  misc_feature 1..4152: note = pXDP77 sequence
  source 1..4152: mol_type = other DNA
atggccaagcagggctccaaggagaagaagggctaccccgagctgaaggaagtgatcaaggcaacctgcaagatcagggtgggacctggcaaggagaccctgacagagggcaactgtctgtgggccctgaagacaatcgacttcatctttgaggatctgaagaccgagccatggaccatcacaaagatgtatacagtgtgggatcggctgaagggactgaccccagaggagacatccaagagagagttcgcctctctgcaggccaccctggcctgcatcatgtgctcccagatgggcatgaagcctgagacagtgcaggccgccaagggcatcatctctatgaaggagggcctgcacgagaataaggaggccaagggcgagaaggtggagcagctgtaccctaacctggagaagcacagggaggtgtatccaatcgtgaatctgcaggcaggaggccgcagctggaaggcagtggagtccgtggtgttccagcagctgcagaccgtggccatgcagcacggcctggtgtctgaggactttgagcggcagctggcctactatgccaccacatggacaagcaaggatatcctggaggtgctggccatgatgccaggcaacagagcccagaaggagctgatccagggcaagctgaatgaggaggcagagcggtgggtgagacagaacccacctggacccaatgtgctgaccgtggaccagatcatgggcgtgggccagacaaaccagcaggccagccaggccaatatggatcaggccaggcagatctgcctgcagtgggtcatcaccgccctgaggagcgtgcgccacatgtcccacaggcctggaaacccaatgctggtgaagcagaagaatacagagtcctacgaggacttcatcgccaggctgctggaggcaatcgacgcagagcccgtgacagatcctatcaagacctacctgaaggtgaccctgtcttatacaaacgccagcaccgactgccagaagcagatggataggaccctgggaacacgcgtgcagcaggcaaccgtggaggagaagatgcaggcctgtcgggatgtgggctctgagggctttaagatgcagctgctggcccaggccctgagaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1063 - DNA, 4638 bp, synthetic construct
  misc_feature 1..4638: note = pXDP85 sequence
  source 1..4638: mol_type = other DNA
atggggcaagaattaagccagcatgaacgttatgtagaacaattgaagcaggctttaaagacacggggagtaaaggttaaatatgctgatcttttgaaattttttgattttgtgaaggatacttgtccttggtttccgcaagagggaaccatagatattaaacggtggcgtagagtaggcgactgtttccaagactattacaatacttttggcccggagaaagtcccagtaactgcattctcttactggaacttaattaaagaattgatagataagaaagaagttaacccacaagtaatggctgccgtagcccaaactgaagaaattttaaaaagtaattctcaaacagacctcacaaagacctctcaaaacccagacttggaccttatttcccttgatagcgacgatgaaggagctaaaagttcctctctacaagataaaggtttatcaagtactaaaaaaccaaaaagattcccagttctgttaacagcacaaactagtaaagaccctgaagaccccaacccctcagaggtagactgggacggcttggaagatgaggcagcgaaatatcataatcccgattggcctcccttcctaacccgtccacctccttacaataaagctactccttccgcacccactgtaatggcggttgttaatccaaaagaggagctcaaagaaaaaattgctcaattagaggaacagattaaattagaagagttacaccaggcactaatttccaaattacaaaaactaaaaacagggaatgaaactgtaactcacccagacacagcaggaggcctttctcgcacgcctcactggccagggcaacatatccctaaaggaaaatgttgcgccagtcgagaaaaggaagaacaaatcccaaaagatattttcccagtgactgaaaccgttgatgggcaaggtcaagcctggagacaccataatggttttgattttgccgtcataaaagaattaaaaacagctgcttcccaatatggggctactgccccatacacattagccatagtggaatctgtagcggacaattggcttacccctacagattggaatacgcttgttagggcagtcctctcaggaggagatcacttactgtggaaatctgagttttttgaaaattgcagagatacggctaaaagaaaccaacaagccggtaatggctgggattttgacatgttaacaggttcgggtaattattccagcaccgatgcacaaatgcagtatgatccaggattgtttgctcaaattcaagcggctgctacaaaagcctggagaaaacttcccgttaagggagacccaggagcctcccttacaggagtcaaacaaggacccgatgagccatttgcagatttcgtacacagacttataacaactgctgggagaatctttggaagtgctgaggccggtgtagactatgtaaaacaactagcatatgaaaatgctaatccagcttgtcaggcagccattcgcccctatagaaagaagacagatttaactggctatatccgtctttgctcggatattgggccctcttatcagcaaggcctggccatggccgccgcctttagcgggcagactgtaaaaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1064 - DNA, 4095 bp, synthetic construct
  misc_feature 1..4095: note = pXDP86 sequence
  source 1..4095: mol_type = other DNA
atgggccaaatcttttcccgtagcgctagccctattccgcgaccgccccgggggctggccgctcatcactggcttaacttcctccaggcggcatatcgcctagaacccggtccctccaattgcgctttccacctgttaagaagatatcatgaaacagtttccggaataccggctcggatctgtcccattaactactccctcctagccagcctactcccaaaaggataccccggccgggtgaatgaaattttacacatactcatccaaacccaagcccagatcccgtcccgtcccgcgccaccgccgccgtcatcccccacccacgaccccccggattctgatccacaaatcccccctccctatgttgagcctacggccccccaagtccttccagtcatgcatccacatggtgctcctcctaaccatcgcccatggcaaatgaaagacctacaggccattaagcaagaagtctcccaagcagcccctgggagcccccagtttatgcagaccatccggcttgcggtgcagcagtttgaccccactgccaaagacctccaagacctcctgcagtacctttgctcctccctcgtggcttccctccatcaccagcagctagatagccttatatcagaggccgaaacccgaggtattacaggttataacccattagccggtcccctccgtgtccaagccaacaatccacaacaacaaggattaaggcgagaataccagcaactctggctcgccgccttcgccgccctgccggggagtgccaaagacccttcctgggcctctatcctccaaggcctggaggagccttaccacgccttcgtagaacgcctcaacatagctcttgacaatgggctgccagaaggcacgcccaaagaccccatcttacgttccttagcctactccaatgcaaacaaagaatgccaaaaattactacaggcccgaggacacactaatagccctctaggagatatgttgcgggcttgtcagacctggacccccaaagacaaaaccaaagtgttagttgtccagcctaaaaaaccccccccaaatggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1065 - DNA, 4158 bp, synthetic construct
  misc_feature 1..4158: note = pXDP87 sequence
  source 1..4158: mol_type = other DNA
atgggcgcgagaaactccgtcttgtcagggaaggaagcagatgaattagaaaaagttaggttacggcccaacggaaagaaaaagtatatgttgaagcatgtagtatgggcagcaaatgaattggacagatttggattagcagaaagcctgttggataacaaagaaggttgtcaaaaaattctttcagttttagctccattagttccgacaggttcagaaaacttaaagagcctttataatactgtctgcgtcatttggtgcattcacgcagaagagaaagtgaaacatactgaggaagcaaaacaaatagtgcagagacatctagtggtggaaacaggaacagcagacagaatgccagcaacaagcagaccaacagcaccacctagtggcagaggaggaaattacccagtgcagcaagtaggtggcaattatgtccacctacccttaagtccaagaacattaaatgcttgggtaaaattagtagaagagaaaaaatttggggcagaggtagtgccaggatttcaagcgctatcagaaggctgcactccctatgatattaatcaaatgctaaattgtgtaggagaacatcaggcagccatgcaaattattagagagattataaatgaagaagctgccgattgggatttacaacacccgcaaccaggtccactaccagcagggcaacttagagagccaagaggatcagacattgcaggaactactagtacagtagatgaacaaatccaatggatgtacaggcaacaaaaccccataccagtaggcaacatttatagaaggtggatccaattagggctgcagaaatgtgtaagaatgtataacccaacaaacattttagatgtgaaacaaggaccaaaagagccatttcaaagctacgtagatagattctacaaaagtctaagagcagagcaaacagatcccgcagtaaagaattggatgacccaaacactgctgattcaaaatgctaacccagattgtaaactagtgctcaagggtctgggcatgaatcccactttagaagaaatgctgacagcctgtcagggagtaggagggccaggacaaaaagctaggttaatggcagaagcattgaaagaggcactgaggccaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1066 - DNA, 5140 bp, synthetic construct
  misc_feature 1..5140: note = pXDP57 sequence
  source 1..5140: mol_type = other DNA
atggcccagaacgagacatttgatcctgtggccctgcagggctactaccctgctggcggcatcctggccgacaatgacattatcaacatcagattcaccagcggacagtggggcatcggcgatagatggctgcaggtgcggctgagactggtggaccctaatactggacagcctctggctcagcctgagtacgaggacacaggcctgcctgccgaaaacaggggtatcgtggtggccgtgtcccacaacgccgccagaaatatcttcaacaacgtgcagccagctggtggccccaacagacacggccctctgcacgacggccaatttcaagtgggcgacgatcccagcgagcacttcgtgcctattgaggaaaacctgatcccccaggagatcgtgaacctgggagcagctagaagagaagtgcggctgctgagagaaatgtgcgtgcggctgctgcacgtgagaagacagatgatgggcatgggcatgcctggcgctatccagcctcaaccgccagtgggccccctgcccgcccctgcccagccccctatccctggcccacctgtgcctccccccgtgcctccccccgcccctccagcccctgtcaacccccctgtccctccagtgcagcctatccaccacctgcctattacccacatccgggccgtgatcggcgagacacctgcccagatcagagatgtgcccctgtggctggcccagtccatccctgccctgaccggcgtttatcctgccatggacgccggaacactgacaagactggtgaacgcgatcaccgccagacaccccggactcgctcttggcatgaacgaggccggctcctggcacgaggccgttcatctgatctggcagaggaccttcggcgctacagccctccatgccttgtctgatgtgctgaagggcatcgcccagcggaacggcgtggtgatggccctggaaatgggcctgatgttcaccaacgacgactgggacctgacctggtctgtgatccggagatgtctgcctggacaagccagcgttgtgaccatccaggcccggctggatgccctgccaaacaaccaggccaggatcatccaggccggctttatcatcagagaggtgtacgaggtgctgggcctggacccactgggccggccactgaacttccctggaggcctgacccagcgagacaccgccgtgcccgtgaccagaggccggggccgcggaagaaccggccctagaagaggccctgtgctgcctgtcagcagcaaccagcgccggcaagaaaccgcaggcggcaaccagcctcagacccaaccccagcagcagaacacattcagcaatcagacaaatcagagaggaaaccagcggcagtggcaaaatagaggaaccgacagccagagacggtacttcttcagacccagaccaagccagcctcagcggtacggcagcaaccagggccctgacaaccctaatccctacagaggaagagatagcaccaatcaaagcggccaggagcggcagctgcctcagcagcaacagggctctagaaggggccctggcagaaacacaaacagcggcaacaacaccgtgcacaccgtgcggcaagtggaatcttctcagctacaacaaaatgcaagccctacagcctctccaagtacaaatcaagggcaacagccttaagggattttatgataccggcgccgagatcacctgcgtgccagccatcttcctgatcgaggaagagcctatcggcgagcggaccatccaaacaatccacggcatcacaaaggaaaaggtgtactacctgacctttaagatccagggcagaaagctggccgctgaagtgattggaacccagctggactacgtgatcatcgcccctagcgacatcccctggtacaagaaatacgagctggaactgacaattaaaatcgacatccagaaacagcaggagcagctgctgcacaccaccaacctctctagcgagggaaagaagtacctgaaggacctgttcatcaagtatgataatctgtggcagaagtgggaaaaccaggtcggccacagaagaggtgccaacaccgtgcacaccgtgcggcaagtggaatctggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1067 - DNA, 4996 bp, synthetic construct
  misc_feature 1..4996: note = pXDP58 sequence
  source 1..4996: mol_type = other DNA
atggcccgggaactgaaccccctgcagctgcaacagctgtacatcaacaatggcctgcagcccaatcccggccacggagatatcatcgcagttagattcacaggcggcccttggggccccggagatagatgggccagagtgaccatccggctgcaggacaacaccggccagcctctgcaagtgcccggatacgacctggagcctggcatcatcaatctgcgggaagatatcctgatcgccggcccatacaacctcatcagaacagcttttctggacctggaacctgccagaggaccagagcggcacggcccgttcggcgacggcagactgcagcctggcgatggactgagcgagggatttcagcctatcaccgacgaggaaatccaggctgaagtgggcaccatcggcgccgcccgtaacgagatccggctgctgagagaagccttgcagagactccaggctggcggtgttggacggcctatccctggggccgtgctgcagcctcaacctgtgatcggacctgtgatccccatcaaccacctgagaagcgtgattggcaacacacctcctaaccccagagatgtggccctgtggttgggcagatctacagccgctatcgagggcgtgttccccatcgtggaccaggtgacccggatgagagtggtgaacgccctggtcgcctctcatcctggcctgaccctgacagagaacgaggccggcagctggaacgccgccatcagcgccctgtggcggaaggcccacggcgctgctgctcagcacgagctggccggagtgctgagcgacatcaacaagaaggaaggcatccagacagccttcaacctgggcatgcagttcaccgatggcaattggtccctggtgtggggaatcatcaggaccctgctgcccggccaggccctggtcacaaacgcccagagccagttcgacctgatgggcgacgacattcagcgggccgagaacttccccagagtgattaacaacctgtacaccatgctgggcctgaacatccacggccagagcatcagacctagagtgcagacccagcctctgcagaccagacctcggaaccctggcagaagccagcagggtcagctgaatcagcctcggcctcagaacagagccaaccagtcctacagaccccctcggcagcagcaacaacacagcgacgtgcctgagcagagggaccagagaggcccatctcaaccgcctagaggctctggcggaggctataacttcagaagaaatccccagcagcctcagcggtacggccaaggcccccccggcccaaacccttacagacggttcggcgacggcggcaatccccagcagcaaggcccgcctccaaatagaggccctgatcagggacctagaccaggcggcaaccctcgcggcggcggcagggggcagggcccccggaacggcggaggcagcgccgccgccgtgcacaccgtgaaagccagcgaaaacgaaactaaaaatggatctgctgaagccgttgacggtggaaagaaagggggtaaagattaaaggttactgggattctcaggccgacatcacctgcgtgccaaaggacctgctgcagggcgaggaacccgtgcggcagcagaatgtgaccaccatccacggcacccaggagggcgatgtctactacgtgaacctgaagatcgacggcagaagaatcaacaccgaggtgatcggcacaacactggactatgctatcatcacccctggcgacgtgccttggatcctgaagaaacctctggaactgacaattaagctggatctggaagagcaacaaggaaccctgctcaacaacagcatcctgagcaagaagggcaaggaagagctgaaacagctgttcgagaagtactccgccctgtggcagagctgggagaaccaggtgggacacagacggggtgccgccgccgtgcacaccgtgaaagccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1068 - DNA, 5401 bp, synthetic construct
  misc_feature 1..5401: note = pXDP59 sequence
  source 1..5401: mol_type = other DNA
atggccgctgtggaaggcgatctggacgtgcaagccctgaccgatctgttcaacaacctgggcatcaaccgggacccccggcaccgggaagtgatcgccctgcggatgacaggcggctggtggggccctgccaccagatacaacctgatcaccgtgctgctgcaggatgatcagggtcagcctcttcagcagccccggtggcgggccgagggccgggccgccaaccccgctgtgatgctgaccctggaagccccatggcaggacctgcggatggcctttgacaacgtcgacctggccgacgacacactgcggtttggccctctggctaacggcaattacatccccggcgacgagtacagcctggagttcatccctcccgccatgcaagagatcgcccaaatgcagagagatgagctggaaaacgtgctggacattgtgggccagatcacaatgcagatgagcgacctgatcggaatgcaggacgcccagatccggggcctggagggccaaatcagaggcctgagaggcaatctgcccgtggccggaacaccaccacctcctcctccaagcctggacctgcagcctgccgccgccagcagcccttacgtggcccctgcgtctagcgctcctgccgcacccgtggcctctgctgatctgggctggttcgccgggggaccttccccaggctctgtggaccctcggctggcccgggtcgcctacaaccccttcctgcccggacctagcgacggcagcggcgtggccccggtgcagccctccgcccctcctgccgccagccctctgctgcccctgccacctgctcagcctgtgcagccagtgatccagtacgtgcaccctcctcctatgaaccctgcccagcagattattcctatccagcacatcagagccgtgaccggcaacgcccccaccaaccctagagagatccctatgtggatcggcagaaacgccagcgccatcgagggcgtgttccccatgaccacccctgatctgaggtgtcgggtgatcaacgccctgctcggcggcaacctgggcctgaacctggaaccacagcactgcgtgacctgggccagcgcaatcgccaccctgtacgttagaacccacggcagctaccccatccaccagctggctgaagtgctgagaggcgtggctaatagcgagggagttgctgccgcttatcagctgggcatgatgctgacaaaccgggattacaacctgatctgggggatcatccgccctctgctgcccggccaggccgtcgtgaccgccatgcagcatagactggatcaggagatcaacgacgccgccagagtggcctctttcatcaatcacctgaacggcgtgtacgagctgctgggcttgaacgccagaggccagagcctgagaatccctgcctctggcggacagaccacggccggaaccagcgccggcagaggcacaagaggaagacgcagccagcaaggcacacctggcagacagagcagcggccagagccagcagcagggaagaagaagcagccagggccagagcagacagtcagactccagcgaccagaacgtgcagagacaatcccagggcggcaacggacggggaggctataatctgagacccaggacctaccagccccagagatacggcggaggcagaggcagaaggtggaacgaccagcctgccagatcagacaaccagcagcggtcccaatctcaacagcctcagtccgaggctagaggcgagcagagcagaaccagcggagccggcagaggacagggcggccgggggaatcaaaacagaaaccagagaagcgccggtggcaatgccgacagaacagtgaacaccgtgacaaccgccagcgcttctacaagcgcctcaggtcaagatggatcctctccagctcctccagcctctggaagcggaaatcaagggaactaaattaaaagcccactgggacagcggagccaccattacatgcatccccgaggcttttctggaagatgagcagcctatccaaacaatgctgatcaagaccatccacggcgagaagcagcagaacgtgtactacctgacattcaagatccagggcagaaaggtggaagccgaggtgctggcctctccttatgactacatcctgctcaatccttctgatgtgccatggctgatgaaaaagcctctgcaactgaccgtgctggtccccctgcaggactaccaggagcggctgctgaaacagaccaccctgcctaaggaacagaaggaccagctggaaaagctgttcctgaagtacgacgccctgtggcagcactgggagaaccaggtgggccacagaagaggtgccagaacagtgaacaccgtgacaaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1069 - DNA, 5401 bp, synthetic construct
  misc_feature 1..5401: note = pXDP60 sequence
  source 1..5401: mol_type = other DNA
atggccgccatcgagggcgatctggacgtgcaggccctggctaacctgttcaacgacctgggcatcaacagaaaccccagacacagagaggtgattgccctgagaatgaccggcggctggtggggccccgctaccagatataatctggtgagcctgctgctgcaggacgaccagggccagcctctgccacagcccagatggcgggctgaaggcagagccgcaaaccccgccgtgatgttcaccctggaagccccctggcaggatctgagactggcctttgacaatatcgacgtgggcgagggcacactgagattcggcccacttgctaacggcaactacatccccggcgacgagttcagcctggagttcctgcctcctgccatgcaggagatcacacagatgcagagagatgagctggaggaagtgctggatgtggtgggccagatcacaatgcagatgaacgacctgatcggcatgcaggacgcccagatccggggactggaaggacaactgagaggactgagaggcaatctgccagtggccggcacacctccacctcctccacccagcctggacctgcagcctgctgccgccagcagcccctacgtggcccctgcaccttccgctcctgctgcctctgccgccgcagccgacctgggatggttcgccggaggccctggccctggatctctggacccccgcctcgcccgggtggcctacaacccctttctgcctggccctagcgacggcagcggtgccgctcccgcccagcctagcgctcctccggtggcctctcctctgccttctctgctgcctgcccagcccatgcaacctgtgatccagtacgtgcaccccccacctatcaatcctgctcaacaggtgatccctattcagcatatcagagccgtgaccggcaacgcccctagcaacccaagagaaatccctatgtggatcggaagaaacgccagcgccatcgagggcgtgttccccatccctacatctgacatccgttctagagtgatcaacgccctgctgggtagacagctgggcctgaacctggatcctcagcactgcatcacctgggccagcgcaatcgccactctgtacgtgcgcacccacggcagctaccctctgcaccagctggccgaggttctgcggagagtctccaacagcgaaggcgcggccgccgcctggcagctgggcatgatgctgaccaaccaggactacaacctcgtgtggggaatggtcagacccctgctgcccggccaggctgtggtcaccgccatgcagcaccggctggatcaggaggtttctgatgccgccagaatcgtgtccttcgtgaaccacctgaacgccgtgtacgagctgctgggcctgaatgccagaggccagaacctcagggtctccaccggcggccagaccaccgctagaacaagcgccggcagaggcgccagaggcagacggtcccagcaggggacccctggcaggcagtctagcggacaggcccctcctcaaggccggagaagcagccagggccagcagcctaggcagtctgagagcggcgaccagaacaaccagcggcagctccagggaggaaacaaccggggcggctataacctgcggcctcggacataccagcctcagcggtacgggggaggccggggccggagatggaacgatcagaccgccagagccgataaccagcagcggagccaatcccaacaacctcagagcgaggcccggggcgagcagagcagaaccagcggcgccggcagagaacagggcggcagaggcaatcaaaatcggaatcaaagatctgccggagaaaacaccgacagatccgtgaacaccgtgacagccaccagcgccagcatcagcgcctcaggtcaaaatggatcctctacaactcctccagcctctggaagcggaaatcaagggaactaaattaaaagcccactgggatagcggagctacaatcacctgcgtgcccgaggcctttctggaagatgagagacctatccagaccatgctgatcaagaccatccacggcgagaagcagcaggacgtctactacctgaccttcaaggtgcagggcagaaaggtggaagccgaggtgctggcctctccttatgactacatcctgctcaaccccagcgacgtgccttggctgatgaaaaagcctctgcagctgacagtgctggtgccactgcacgagtaccaggagcggctgctgcaacaaaccgccctgcctaaggaacagaaagagctgctgcagaagctgttcctgaagtacgacgccctgtggcagcattgggaaaaccaggtgggccaccggagaggtgccagatccgtgaacaccgtgacagccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1070 - DNA, 5811 bp, synthetic construct
  misc_feature 1..5811: note = pXDP61 sequence
  source 1..5811: mol_type = other DNA
atggggcaagaattaagccagcatgaacgttatgtagaacaattgaagcaggctttaaagacacggggagtaaaggttaaatatgctgatcttttgaaattttttgattttgtgaaggatacttgtccttggtttccgcaagagggaaccatagatattaaacggtggcgtagagtaggcgactgtttccaagactattacaatacttttggcccggagaaagtcccagtaactgcattctcttactggaacttaattaaagaattgatagataagaaagaagttaacccacaagtaatggctgccgtagcccaaactgaagaaattttaaaaagtaattctcaaacagacctcacaaagacctctcaaaacccagacttggaccttatttcccttgatagcgacgatgaaggagctaaaagttcctctctacaagataaaggtttatcaagtactaaaaaaccaaaaagattcccagttctgttaacagcacaaactagtaaagaccctgaagaccccaacccctcagaggtagactgggacggcttggaagatgaggcagcgaaatatcataatcccgattggcctcccttcctaacccgtccacctccttacaataaagctactccttccgcacccactgtaatggcggttgttaatccaaaagaggagctcaaagaaaaaattgctcaattagaggaacagattaaattagaagagttacaccaggcactaatttccaaattacaaaaactaaaaacagggaatgaaactgtaactcacccagacacagcaggaggcctttctcgcacgcctcactggccagggcaacatatccctaaaggaaaatgttgcgccagtcgagaaaaggaagaacaaatcccaaaagatattttcccagtgactgaaaccgttgatgggcaaggtcaagcctggagacaccataatggttttgattttgccgtcataaaagaattaaaaacagctgcttcccaatatggggctactgccccatacacattagccatagtggaatctgtagcggacaattggcttacccctacagattggaatacgcttgttagggcagtcctctcaggaggagatcacttactgtggaaatctgagttttttgaaaattgcagagatacggctaaaagaaaccaacaagccggtaatggctgggattttgacatgttaacaggttcgggtaattattccagcaccgatgcacaaatgcagtatgatccaggattgtttgctcaaattcaagcggctgctacaaaagcctggagaaaacttcccgttaagggagacccaggagcctcccttacaggagtcaaacaaggacccgatgagccatttgcagatttcgtacacagacttataacaactgctgggagaatctttggaagtgctgaggccggtgtagactatgtaaaacaactagcatatgaaaatgctaatccagcttgtcaggcagccattcgcccctatagaaagaagacagatttaactggctatatccgtctttgctcggatattgggccctcttatcagcaaggcctggccatggccgccgcctttagcgggcagactgtaaaagattttcttaacaacaaaaataaagagaaaggagggtgttgctttaaatgcggtaaaaaaggacactttgcaaaaaattgtcatgaacatgcacataacaatgctgaaccaaaagttcccggactctgccctagatgtaaaagagggaaacattgggccaatgaatgcaaatccaaaactgataatcaaggaaacccaataccaccccatcagggaaacggggccagccccaggccccgaaacaagcttatggggcagtcagctttgttccagccaacaaaaacaacccatttcaaagcttaccagagccaccccaggaagtgcaggattggacctctgttccacctcccacacagtattaacgcctgaaatggggccccaagcgttaagcactggaatatatggaccactgcctcccaacacttttggattaatcctaggccgaagtagcattactatgaagggtctacaagtttatccaggagtaattgataatgactataccggagaaattaaaattatggcaaaagctgttaacaatattgttactgtctctcaaggcaacagaatagctcaattaatcctcctgcctctgatcgagacagacaataaggtacaacaaccttatagaggacaaggaagttttggatcctcagacatatattgggtccaacctattacttgtcaaaaaccttccttaacattatggttagatgacaaaatgttcacaggcttaatagatacgggggctgatgtcacaattatcaagctggaggactggcctcctaattggcctataacagataccttaaccaatttaagaggaataggacaaagtaacaaccctaaacaaagttctaaatatcttacttggagagataaagaaaacaattctggtctcatcaaaccgtttgttattcctaacttacctgtcaatctttggggccgagatttactttctcaaatgaaaattatgatgtgtagccccaatgacatagtaactgctcaaatgttagcccagggctacagcccaggaaaagggttaggaaaaaaggaaaatggcattctacatcctatcccaaatcaaggacaatctaacaaaaaaggttttggaaatttttaactgcggccattgacatacttggtgccccacaggtgatggctgctgtcgccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1071 - DNA, 5077 bp, synthetic construct
  misc_feature 1..5077: note = pXDP62 sequence
  source 1..5077: mol_type = other DNA
atgggccaaatcttttcccgtagcgctagccctattccgcgaccgccccgggggctggccgctcatcactggcttaacttcctccaggcggcatatcgcctagaacccggtccctccaattgcgctttccacctgttaagaagatatcatgaaacagtttccggaataccggctcggatctgtcccattaactactccctcctagccagcctactcccaaaaggataccccggccgggtgaatgaaattttacacatactcatccaaacccaagcccagatcccgtcccgtcccgcgccaccgccgccgtcatcccccacccacgaccccccggattctgatccacaaatcccccctccctatgttgagcctacggccccccaagtccttccagtcatgcatccacatggtgctcctcctaaccatcgcccatggcaaatgaaagacctacaggccattaagcaagaagtctcccaagcagcccctgggagcccccagtttatgcagaccatccggcttgcggtgcagcagtttgaccccactgccaaagacctccaagacctcctgcagtacctttgctcctccctcgtggcttccctccatcaccagcagctagatagccttatatcagaggccgaaacccgaggtattacaggttataacccattagccggtcccctccgtgtccaagccaacaatccacaacaacaaggattaaggcgagaataccagcaactctggctcgccgccttcgccgccctgccggggagtgccaaagacccttcctgggcctctatcctccaaggcctggaggagccttaccacgccttcgtagaacgcctcaacatagctcttgacaatgggctgccagaaggcacgcccaaagaccccatcttacgttccttagcctactccaatgcaaacaaagaatgccaaaaattactacaggcccgaggacacactaatagccctctaggagatatgttgcgggcttgtcagacctggacccccaaagacaaaaccaaagtgttagttgtccagcctaaaaaaccccccccaaatcagccgtgcttccggtgcgggaaagcaggccactggagtcgggactgcactcagcctcgtcccccccccgggccatgccccctatgtcaagacccaactcactggaagcgagactgcccccgcctaaagcccactatcccagaaccagagccagaggaagatgccctcctattagacctccccgctgacattccacacccaaaaaactccatagggggggaggtttaacctccccccccacattacagcaagtctttcttaaccaagacccagcatctattctgccagttataccgttagatcccgcccgtcggcccgtaattaaagcccaggttgacacccagaccagccacccaaagactatcgaagctctactagatacaggagcagacatgacagtccttccgatagccttgttctcaagtaatactcccctcaaaaatacatccgtattaggggcagggggccaaacccaagatcactttaagctcacctcccttcctgtgctaatacgcctccctttccggacaacgcctattgttttaacatcttgcctagttgataccaaaaacaactgggccatcataggtcgcgatgccttacaacaatgccagggcgtcctgtacctccctgaggcaaaagggccgcctgtaatcttgccaatacaggcgccagccgtccttggactagaacacctcccaaggcccccccaaatcagccagttccctttaaaccagaacgcctccaggccttgcaacacttggtccggaaggccctggaggcaggccatatcgaatcctacaccgggccaggaaataacccagtattcccagttaaaaaggccaatggaacctggcgattcatccacgacctgcgggccactaactctctaaccatagacctctcatcatcttcccccgggccccctgacttgtccagcctgccaaccacacgtgcccctcaagtgctgccagtgatgcacggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1072 - DNA, 4871 bp, synthetic construct
  misc_feature 1..4871: note = Pxdp63 sequence
  source 1..4871: mol_type = other DNA
atgggcgcgagaaactccgtcttgtcagggaaggaagcagatgaattagaaaaagttaggttacggcccaacggaaagaaaaagtatatgttgaagcatgtagtatgggcagcaaatgaattggacagatttggattagcagaaagcctgttggataacaaagaaggttgtcaaaaaattctttcagttttagctccattagttccgacaggttcagaaaacttaaagagcctttataatactgtctgcgtcatttggtgcattcacgcagaagagaaagtgaaacatactgaggaagcaaaacaaatagtgcagagacatctagtggtggaaacaggaacagcagacagaatgccagcaacaagcagaccaacagcaccacctagtggcagaggaggaaattacccagtgcagcaagtaggtggcaattatgtccacctacccttaagtccaagaacattaaatgcttgggtaaaattagtagaagagaaaaaatttggggcagaggtagtgccaggatttcaagcgctatcagaaggctgcactccctatgatattaatcaaatgctaaattgtgtaggagaacatcaggcagccatgcaaattattagagagattataaatgaagaagctgccgattgggatttacaacacccgcaaccaggtccactaccagcagggcaacttagagagccaagaggatcagacattgcaggaactactagtacagtagatgaacaaatccaatggatgtacaggcaacaaaaccccataccagtaggcaacatttatagaaggtggatccaattagggctgcagaaatgtgtaagaatgtataacccaacaaacattttagatgtgaaacaaggaccaaaagagccatttcaaagctacgtagatagattctacaaaagtctaagagcagagcaaacagatcccgcagtaaagaattggatgacccaaacactgctgattcaaaatgctaacccagattgtaaactagtgctcaagggtctgggcatgaatcccactttagaagaaatgctgacagcctgtcagggagtaggagggccaggacaaaaagctaggttaatggcagaagcattgaaagaggcactgaggccagatcaactcccatttgcagcagtccaacagaaaggacaaaggaagacaatcaagtgttggaattgtggaaaggagggacactctgcaaaacaatgcagggcccctagaagacagggctgctggaagtgtggaaaaacgggtcatgttatggccaaatgccctgaaagacaggcgggttttttagggcttggcccatggggaaagaagccccgcaatttccccatggcccagatgcctcaggggctgataccaactgctcccccagaggatccagctgtggatctactgaagaattacatgaagatgggcagaaagcagagggagaacagagagagaccttacaaggaggtgacagaggatttgctgcacctcaattctctctttggagaagaccagtagtcactgcctacattgaagaacagcccgtagaagtattattagatacaggggctgacgattcaattgtagcagggatagaattgggtccaaattatacccctaaaatagtaggaggaataggaggcttcattaacaccaaagaatataaagatgtaaaaataaaagtcttaggcaaggtaattaagggaacaattatgacgggagataccccaattaatatttttggcagaaatttgctaacagctatgggcatgtctttaaatctccccatagctaaggtggagggtgccggcggcaactaccccgtgcagcaaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1073 - protein, 8 aa, synthetic construct
  REGION 1..8: note = cleavage site
DCLDFDND

SEQ ID NO: 1074 - protein, 8 aa, synthetic construct
  REGION 1..8: note = cleavage site
DLVLLSAE

SEQ ID NO: 1075 - protein, 8 aa, synthetic construct
  REGION 1..8: note = cleavage site
PQVMAAVA

SEQ ID NO: 1076 - protein, 8 aa, synthetic construct
  REGION 1..8: note = cleavage site
PAILPIIS

SEQ ID NO: 1077 - protein, 8 aa, synthetic construct
  REGION 1..8: note = cleavage site
PQVLPVMH

SEQ ID NO: 1078 - protein, 8 aa, synthetic construct
  REGION 1..8: note = cleavage site
SSLYPVLP

SEQ ID NO: 1079 - protein, 8 aa, synthetic construct
  REGION 1..8: note = cleavage site
SSLYPALT

SEQ ID NO: 1080 - protein, 8 aa, synthetic construct
  REGION 1..8: note = cleavage site
AGGRSWKA

SEQ ID NO: 1081 - protein, 8 aa, synthetic construct
  REGION 1..8: note = cleavage site
SEEYPIMI

SEQ ID NO: 1082 - protein, 8 aa, synthetic construct
  REGION 1..8: note = cleavage site
GGNYPVQQ

SEQ ID NO: 1083 - protein, 8 aa, synthetic construct
  REGION 1..8: note = cleavage site
REVYPIVN

SEQ ID NO: 1084 - protein, 8 aa, synthetic construct
  REGION 1..8: note = cleavage site
SAVHSVRL

SEQ ID NO: 1085 - protein, 8 aa, synthetic construct
  REGION 1..8: note = cleavage site
RTVNTVRV

SEQ ID NO: 1086 - protein, 11 aa, synthetic construct
  REGION 1..11: note = cleavage site
NTVHTVRQVES

SEQ ID NO: 1087 - protein, 8 aa, synthetic construct
  REGION 1..8: note = cleavage site
AAVHTVKA

SEQ ID NO: 1088 - protein, 8 aa, synthetic construct
  REGION 1..8: note = cleavage site
RTVNTVTT

SEQ ID NO: 1089 - protein, 8 aa, synthetic construct
  REGION 1..8: note = cleavage site
RSVNTVTA

SEQ ID NO: 1090 - DNA, 5178 bp, synthetic construct
  misc_feature 1..5178: note = pXDP40 sequence
  source 1..5178: mol_type = other DNA
atggaagccgtgatcaaggtgatcagctccgcatgcaagacctactgtggcaagacgagcccaagcaagaaggaaatcggcgctatgctgagcctgctgcagaaggagggcctcctgatgagcctgtctgatctgtacagcccaggtagctgggaccctatcaccgccgccctgacacagagagccatggtgctgggcaaaagcggcgagctgaagacatggggactggtgctgggcgccctgaaagccgctagagaagagcaagtaaccagcgagcaggccaagttctggctgggactgggcggcggtagagtgagcccccctggccctgagtgcatcgagaagcctgccaccgagcggcgcattgacaaaggcgaagaagtgggcgagacaaccgtgcagagagacgccaagatggctccagaagagacagcaaccccaaagaccgtgggcaccagctgctaccactgcggcaccgctatcggctgcaactgcgccaccgccagcgcgcctcctcccccgtatgtgggcagcggcctctacccctccctggcaggagtgggagagcagcagggccagggcggagatacacccagaggcgccgagcagcctagagccgaacccggccacgccggccaggcccctggccccgccctgaccgactgggccagaatcagagaggagctggcctctacaggccctccagtggtcgccatgcctgtggtgatcaagaccgagggacctgcctggacccctctggaacctaaactgattacacggctggctgataccgtcagaaccaagggcctcagaagccccatcacaatggccgaagtggaagccctgatgagcagcccactgctgcctcacgacgtgaccaacctgatgcgggtgatcctgggccccgccccttacgccctgtggatggacgcctggggcgtgcagctgcaaacagttatcgccgccgccacaagagacccccggcacccagccaacggccagggcagaggcgagagaacaaacctggatcggctgaagggcctcgccgatggcatggccggcaatcctgagggccaggctgctctgctgagacccggggaactggttgctatcaccgccagcgccctgcaggccttcagagaagtggcccggctggccgagcctacagacccctgggccgagatcacccagggcccttctgagagcttcgtggacttcgccaacagactgatcaaggccgttgagggctccgacctgcctcctagcgcccgcgcccccgtgatcatcgactgttttagacagaaatcgcaacccgacatccagcagctgatccgggccgctccttctaccctgaccacacctggcgagatcatcaagtacgtgctggacagacagaagaccgcccccctgaccgacagaggaatcgccgccgccatgtctagcgccattcagcctctggtgatggccgtggtcaacagagaaagagatggacagacaggttctggcggcagagcccggggcctgtgctacacctgcggatcccctggacactaccaggcccagtgtcctaagaaaagaaagtctggtaacagcagagagcggtgccagctgtgtgatggcatgggccacaacgccaaacagtgccggagacgggacggaaaccaaggacaaagacccggccggggactgagcagcggaccttggcctgtcagccagcaacctgccgtgtccctggctatgaccatggaacacaaggaccggcctctggtgcgggtgatcctgacaaataccggctctcaccccgtgaagcagcggtcagtgtacatcacagccctgctggacagcggcgctgatatcaccatcattagcgaggaggactggcctaccgactggcccgtgatggaagctgccaatccccagatccacggcatcggaggcggaatcccgatgagaaagtccagagacatgatcgaggtgggcgtgatcaaccgggacggctctcttgagagacctctgctgctgttccccgccgtggctatggtgcgaggcagcatcctgggccgcgactgcctgcagggcctgggcctgagactgaccaacctgaactttagccagggtgccaccagctgctaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1091 - DNA, 5187 bp, synthetic construct
  misc_feature 1..5187: note = pXDP41 sequence
  source 1..5187: mol_type = other DNA
atggaggccgtgatcaaggtgatcagcagcgcatgcaagacctactgcggcaagaccagcccatctaagaaagagatcggcgccatgctgagcctgctccaaaaggaaggcctgctgatgagcccttccgacctgtacagccccggaagctgggacccaatcaccgctgccctgacccagcgggccatggtgctgggaaagagcggcgagctgaagacctggggcctggtgctgggagccctgaaggccgccagagaggaacaagtgacaagcgaacaggccaagttctggctgggactgggcggaggaagagtcagccctcctggcccagagtgcatcgagaagcccgctacagagagaagaatcgataagggcgaagaggtgggcgagacaacagtgcagagagacgccaagatggctcctgaggaaaccgccacacctaagaccgtgggcacatcttgttaccactgcggcaccgccattggatgtaactgcgctacagccagcgcccccccccctccctacgtgggcagcggactttatcctagcctggccggcgtgggagagcagcagggccaaggcggagatacacccagaggcgccgagcagcctagagccgaacccggccacgccggactggcccctggcccagccctgaccgactgggcccgcatccgggaagaactggcttctaccggccccccggtggtcgccatgcctgtggttatcaagacagagggccctgcttggacccctctggaaccaaagctgattacaagactcgccgacaccgtgcggaccaagggcctgcggagccctatcaccatggccgagatggaagctctgatgagcagcccactgctgccccacgacgtgaccaacctgatgagagtgatcctgggccccgccccttacgccctgtggatggacgcctggggggtgcagctgcagaccgtgattgccgccgccaccagagatcctagacaccctgctaacggccaaggcagaggcgaaagaaccaaccttgacagactgaaaggcctggccgatggaatggtcggcaacagcgaaggccaggccgccctgctgagacctggcgagctggtggctatcacagccagcgccctgcaggccttcagagaagtggcccgactggctgagcccacggacccttgggccgacatcatgcagggcccttctgagagcttcgtggacttcgccaatagactgatcaaggccgtcgagggcagcgatcttcctcctagcgcgagagcccctgttatcatcgactgcttccggcagaaaagccagcccgacatccaacagctgatcagagccgccccttccaccctgaccacaccaggcgagatcatcaagtacgtgctggatagacagaagaccgcccctctgaccgatcagggcatcgccgctgccatgtcctctgccatccagcctctggtgatggccgtggtgaacagagagagagacggccagacaggctccggcggccgggccagagagctgtgctacacctgtggctctccaggccactaccaggctcagtgtcctaaaaagcggaagtctggcaattctagagagcggtgccagctgtgcaacggcatgggccataatgccaaacagtgtcggaaacgggacggaaaccagggccagagaccaggcagaggcctgtcttctggcccctggcccggccctgagcctcctgctgtgtccctggctatgaccatggaacacaaggacagacccctggtgcgggtgatcctgacaaacaccggaagccaccccgtgaagcagcgctccgtgtacatcacagcccttctggacagcggcgccgacatcaccatcatcagcgaggaagattggcctacagactggcctgtgatggaagccgcaaacccccagatccacggcatcggcggaggtatacccatgcggaagagcagagacatgatcgagctgggcgtgatcaaccgggacggcagcctggaacggcccctgctgttgtttcctgctgtggctatggtgcggggaagcatcctgggcagagattgcctgcagggcctgggcctgcgcctgaccaacctgtgaggagggccactgttctcaggtgccacatcttgttaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1092 - DNA, 5684 bp, synthetic construct
  misc_feature 1..5684: note = pXDP42 sequence
  source 1..5684: mol_type = other DNA
atgggccagacccacagcagacaactgttcgtgcacatgctgtccgtgatgctgaagcacagaggcatcaccgtgtctaagcctaagctgatcaacttcctgagcttcatcgaggaagtgtgtccttggtttccacgggaaggcacagtgaacctggaaacatggaaaaaggtgggcgaacagatcagaacccactacaccctgcacggccctgagaaggtgcctgtggaaacactttccttctggaccctgatccgcgactgcctggatttcgacaatgacgagctgaaaagactgggcaacctgctcaagcaggaggaagatcctctgcacgaccctgacagcgagaacagctacgacgcccctcctcctcctcatcctagcctgcactctagcagaccttccgacaacgacgacctgctgtctagcacagacgaggccgagctggacgaggaagccgccaagtaccaccaggaggactggggcttcctggctcaggagaaaggcgccctgacaagcaaggacgagctggtggaatgtttcaagaacctgaccatcgccctgcagaacgctggaatcaagctgccagccaacaacgataagttcccctccgccccccctctgcctcctgcctacgcccctagcgtggtggccggactggatccaccccccggccccctgcccccaagcaagaacatgtctccactgcagaaagccctgagacaagcccagaggctgggcgaagttgtgtccgatttcagcctggccttccccgtgttcgagaacaacaaccagcggtactacgagagcctgcctttcaagcagctgaaggaactcaaaatcgcatgcagccagtacggccctaccgcaccttttaccatcgccatgatcgagaacctcggcacccaggccctgccacctaatgattggaagcagacagccagagcctgcctgtcaggcggagattacctgctgtggaagagcgagttcttcgagcaatgcgccagaatcgctgacgtgaaccggcagcagggcatccagacgagctacgagatgctgatcggcgagggaccctaccaggccaccgacacccagctgaacttcctgcctggggcctatgcccaaatcagcaacgccgccagacaggcttggaagaaactgcctagctcttctacaaagaccgaggacctgagcaaagtgcggcaaggccccgatgagccctaccaggactttgtcgccagactgctcgacaccatcggcaagatcatgagcgacgaaaaggccggcatggtcctggctaagcaactggctttcgagaatgctaatagcgcctgtcaggccgccctgcggccttacagaaagaagggcgacctgtccgattttatcagaatctgcgccgacatcggcccctcttatatgcagggaattgccatggccgctgctctgcagggcaaaagcatcaaggaagtgcttttccagcagcaagctcggaacaagcggggaagacagagaagcggcaatagcggttgttttgtgtgcggccagcccggccaccgcgccgccgtgtgcccccagaagcagcagagccccgtgaacacccctaatctgtgcccgcgctgtaaaaaaggaaagcattgggcacgagattgccggtccaaaacagatgttcaaggtacccctttacccccggtgtcgggaaactgggtgaggggccagcccctggccccgaaacaatgttatggggcaacactgcaggttccaaaagaaccattgcagacctctgtcgagccacaagaggcagcgcgggattggacctctgtgccacctcctacacagtattaactcccgagatgggggtccaaaccctggctacaggcgtgttcggtcctctgccccccggcaccgccggcctgctgctgggcagaagcagcgccagcctgaagggcatcctgatccatcctggagtgattgacagcgactacaccggcgagatcaagatcctggcctctgcccctaacaagatcatcgtgatcaacgccggccaaagaatcgcccagctgctgctcgtgcctctggtgatccagggcaaaaccatcaaccgggacaggcaggacaagggatttggatcttctgacgcctattgggtgcagaacgtgaccgaggccagacctgaactggaacttagaatcaatggcaagctgttccggggcgtgctggatacaggcgccgacatcagcgtgatcagcgacaaatactggcccaccacctggcctaagcagatggctatctctacactgcagggcatcggccagacaaccaaccccgagcagagcagcagcctgctgacctggaaggacaaggacggccacaccggccaattcaagccctacatcctgcctcacctgcctgtgaacctgtggggcagagatatcctgagcaagatgggcgtctacctgtactcccctagccctaccgtgacagatctgatgctggaccagggcctgctgcctaatcagggcctcggaaagcaacaccagggaattatcctgccactggacctgaaaagcaaccaggatagaaagggcctgggatgcttcccctgaggacctctgattctcctgggtgccgactgcctggatttcgacaatgacggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1093 - DNA, 5637 bp, synthetic construct
  misc_feature 1..5637: note = pXDP43 sequence
  source 1..5637: mol_type = other DNA
atgggcgtgtccggctcaaagggccagaagctgtttgtgtccgtgctgcagcgtctgctgtccgaacggggcctacacgtgaaagagagcagcgccatcgagttctaccagtttctgatcaaggtgtcaccctggttccccgaggaaggcggcctgaatctgcaggattggaagagagtgggcagagaaatgaagaagtacgccgctgagcacggcaccgacagcatccccaagcaggcttatcctatctggctgcaactgagagagatcctgacagagcaatctgacctggtgctgctgagcgccgaggccaagtccgtgacagaggaagaactggaagaaggcctgacaggactgctgagcgccagcagccaggagaagacctacggcacaagaggcaccgcctatgccgaaatcgacaccgaggtggataagctgagcgagcacatctacgacgagccctacgaggagaaggaaaaggccgacaagaacgaggagaaggaccacgtgcggaaggtcaagaagatcgtgcaaagaaaggaaaatagcgagcataagagaaaggagaaagatcagaaggccttcctggcaaccgactggaacaacgacgacctgagccctgaggactgggacgacctggaagagcaggccgcccactaccacgatgacgacgaactgatcctgcctgtgaagagaaaggtggacaagaagaagccgctcgccctgaggcggaaacctctgcccccggttggcttcgccggagccatggccgaggctagagagaagggcgatctgaccttcacatttcccgtggttttcatgggagaatccgacgacgatgatacccctgtgtgggaacctctgcccctgaagacactgaaggaactgcagtctgccgtgcggaccatgggccctagcgccccttacaccctccaggtggtggacatggttgcctctcagtggctgacacctagcgattggcaccaaaccgccagagccaccctgtctcctggggactacgtgctgtggcggaccgagtacgaggagaagagcaaggaaaccgtgcagaagaccgctggcaagcggaaaggcaaggtgagcctggatatgctgctgggcacaggtcagttcctgagcccttcttctcagatcaagctttctaaagatgtgctgaaggatgtgaccaccaacgccgtcctggcctggagagccatccctcctccaggcgtcaaaaagacagtgctggccggactcaagcagggaaatgaggaaagctacgagacattcatcagcagactggaagaggccgtgtacagaatgatgcctagaggagaaggcagcgacatcctgatcaagcagctggcttgggagaacgctaattctctgtgccaggacctgatccggcctatgcggaagaccggcaccatgcaggactacatcagagcctgtctggatgcctcccctgccgtggtgcagggcatggcctacgccgccgcaatgagaggacaaaagtacagcaccttcgtgaaacagacatacggcggcggaaaaggcggacagggctctgaaggccctgtgtgcttcagctgcggcaaaacaggtcacattaagcgggattgcaaggaagagaaaggaagcaagcgcgctcctcctggactgtgtcctagatgcaagaaaggctaccactggaagagcgagtgcaagagcaagttcgacaaggacggcaaccctctgccaccactggaaactaacgccgaaaacagcaaaaaccccacacagaaaggcgacaaaggaaaggacagcggactgaaccccgaagcccctcctttcaccatccacgacctgccacgaggcaccccaggcagtgccggcttggacctgagcagccagaaagacctgatcctgtctctggaagacggcgtgtccctggtgccaaccctggtgaagggcaccctgcccgagggcaccacgggactgatcatcggcagatccagcaactacaagaaaggcctggaggtgctgcccggcgtgatcgactccgacttccagggcgaaattaaggtcatggtaaaggccgctaagaacgccgtgatcatccacaagggcgagcggatcgcgcagctgctgctgctgccttatctgaaactgcctaaccctatcatcaaggaggaaagaggcagcgagggatttggcagcacctcccacgtgcactgggtgcaggagatcagcgacagcagacccatgctgcacatcagcctgaacggcagaagattcctgggcctgctggacaccggggccgataagacctgcatcgccggcagagattggcccgccaactggcctattcaccagaccgagagcagcctgcagggcttgggaatggcttgtggcgtggctagaagctctcagcctctgagatggcagcacgaggataagtctggcattatccatcctttcgtgatccccacattgccttttaccctctggggccgggacatcatgaaagagataaaggtgcggctgatgaccgatagcccagacgacagccaggatctgacatctctgtacggcttaggtgccgacctggtgctgctgagcgccgagggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1094 - DNA, 5811 bp, synthetic construct
  misc_feature 1..5811: note = pXDP44 sequence
  source 1..5811: mol_type = other DNA
atgggccaggagctgtcccagcacgagcggtacgtggagcagctgaagcaagcccttaaaacaagaggcgtgaaggtgaaatacgccgacctgctgaagttcttcgattttgtgaaggatacctgcccttggttccctcaggagggcaccatcgacatcaagagatggcgcagagtgggcgactgcttccaagattactacaacaccttcggacctgagaaagtgcctgtgaccgccttcagctactggaacctgatcaaggaactgatcgacaaaaaggaagtgaacccacaggtgatggctgctgtcgcccagaccgaggaaatcctgaagagcaacagccagacagacctgaccaagaccagccagaaccctgacctggatctgatcagcctggacagcgatgatgagggcgccaagtccagcagcctgcaggacaagggcctgagcagcaccaaaaagcctaagcggttccccgtcctgctgaccgcccagacaagcaaggacccagaggatcctaacccaagcgaggtggactgggacggcctggaggacgaggccgctaagtaccacaaccctgactggccccccttcctgacaagacctccaccttacaacaaggctacccctagcgcccctaccgtgatggccgtggtgaaccctaaagaggaactgaaagaaaagatcgcccagctggaagagcagatcaaactggaagagctgcaccaggccctgatttctaagctgcaaaagctgaaaaccggcaacgagacagtcactcaccctgatacagccggaggcctgagcagaacaccacattggcccggccagcacatccctaagggcaagtgctgcgccagccgggaaaaggaagagcagatccccaaggatatcttccctgtgaccgaaaccgttgacggacagggccaggcatggagacaccacaatggcttcgacttcgccgtgatcaaggaactgaagacagccgcctctcaatacggcgccaccgcaccttacaccctggctatcgtggaatccgtcgccgacaactggctgaccccaaccgactggaataccctggtgcgggccgtgctgtctggcggcgaccacctgctctggaagtctgagttcttcgagaactgtagggacaccgctaagcggaaccagcaggccggcaatggatgggattttgacatgctgaccggcagcggcaactacagctctacagacgcccaaatgcagtacgaccctggcctgttcgcccagattcaggccgctgccacaaaggcctggcggaagctgcccgtgaagggggatcccggcgccagcctgaccggcgtgaagcagggccccgatgagcctttcgccgacttcgtgcatagactgatcaccacagccggcagaatcttcggctccgccgaagccggcgtggactacgtgaagcagctggcttacgagaacgccaaccctgcctgccaggccgcaatcagaccctatagaaagaagacagatctgaccggctacatccggctgtgcagcgacatcggcccttcctatcagcagggactggctatggccgctgcctttagcggccagaccgtgaaggacttcctgaacaacaagaacaaggaaaagggcggatgttgttttaagtgcggcaagaaaggacactttgccaaaaactgccacgagcacgcccacaacaacgccgagcccaaggtgcccggcctgtgtcctcggtgcaagagaggcaagcactgggccaatgagtgcaagtccaagacagataaccagggaaatccaatccccccccatcagggaaatggtgcttctcctagacctagaaacaagctgatgggccaaagcgccctgttccagcctaccaagacaacccacttcaaggcctaccagagccaccccagaaagtgcagaatcggccctctgttccacctgccccacagcatcaacgcctgaaatggggccccaagcgttaagcactggaatatatggaccactgcctcccaacacttttggattaatcctaggccgaagtagcattactatgaagggtctacaagtttatccaggagtaattgataatgactataccggagaaattaaaattatggcaaaagctgttaacaatattgttactgtctctcaaggcaacagaatagctcaattaatcctcctgcctctgatcgagacagacaataaggtacaacaaccttatagaggacaaggaagttttggatcctcagacatatattgggtccagcctatcacctgtcagaagccttctctgaccctgtggctggacgacaagatgttcaccggcctcatcgacaccggcgccgacgtgacaatcatcaagctggaagattggcctccaaattggcccattacagataccctgaccaacctgagaggcatcggacagtccaacaaccccaagcagagcagcaagtacctgacatggcgggacaaggagaacaacagcggcctgatcaaaccttttgtgatccccaatctgcctgtgaacctgtggggaagagatctgctgtctcagatgaagatcatgatgtgcagcccaaacgacatcgtgaccgcccagatgctggctcaaggctacagccccggcaaaggcctgggcaagaaagagaatggaatcctgcaccctatccctaaccagggccagagcaacaagaagggcttcggcaacttctgactgcggccattgacatacttggtgccccacaggtgatggctgctgtcgccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1095 - DNA, 4779 bp, synthetic construct
  misc_feature 1..4779: note = pXDP45 sequence
  source 1..4779: mol_type = other DNA
atgggcaactctcctagctacaatccccctgccggcatctccccatctgactggctgaacctgctgcagtccgcccagcgcctgaatccaaggcctagcccatccgacttcacagatctgaagaactatatccactggtttcacaagacccagaagaagccttggaccttcacaagcggaggaccaacatcctgcccaccaggcagatttggaagggtgccactggtgctggccaccctgaacgaggtgctgtccaatgagggaggagcacctggagcctctgccccagaggagcagcctccaccctacgaccctccagccatcctgcccatcatctccgagggaaacaggaataggcacagggcatgggcactgagggagctgcaggatatcaagaaggagatcgagaataaggcccctggctctcaagtgtggatccagacactgcggctggccatcctgcaggcagacccaacccctgcagatctggagcagctgtgccagtacatcgccagccctgtggaccagaccgcccacatgacatccctgaccgcagcaatcgcagcagcagaggcagcaacacccagcagagtgctgacccctaagaccggcacactgacccagcagtctgcccagccaaacgcaggcgatctgaggagccagtatcagaatctgtggctgcaggccggcaagatctccctgctggtgctgcagctgcagccctggtctaccatcgtgcagggacctgcagagagctccgtggagtttgtgaaccgcctgcagatctccctggccgacaacctgccagatggcgtgctgcggaatcccctgctgacacctctggtcatgcagatgctgaccgagtctgtgagcaagttctgcaggggagaggccagcggaaggggaggagccaagacagcaggactgagaaccatcggaccacctaggatgaagcagcctgccctgctggtgcacaccccaggaccaaagatgcctggaccacgccagccagcacctaagaggccaccacctggaccttgctacagatgtctgaaggagggacactgggccagggactgcccaacaaaggcaaccggcccaccacctggaccatgccccatctgtaaggacccaagccactggaagcgcgattgtcccacactgaagtccaagaattaatagaggggggacttagcgccccccaaaccataacacctataacagattctcttagtgaggccgaattagaatgcttactctctattcctctggcccggagccgccctagcgtggccgtgtacctgagcggcccttggctgcaaccttctcagaaccaggccctgatgctggttgatacaggcgccgagaacaccgtgctgcctcagaattggctggtgcgggactaccccagaatccctgccgctgtgctgggagccggaggcgtgtcccggaacagatacaactggctgcagggccctcttacactggctctgaaacctgaaggcccattcatcaccatcccaaagatcctggtcgacaccttcgacaagtggcagatcctgggcagagatgtgctgagcagactgcaggccagcatcagcatccccgaggaagtgcggccccccgtggtgggcgtcttggatgcccccccgagccacattggattagaacatctgccccccccacctgaggtgcctcaattccctttaaactagaggtgccccagccatcctgcccatcatctccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1096 - DNA, 5078 bp, synthetic construct
  misc_feature 1..5078: note = pXDP46 sequence
  source 1..5078: mol_type = other DNA
atgggtcagattttcagcagaagcgcctcccctattcctagacctccacggggcctggccgcccaccactggctgaatttcctgcaggccgcttatagactggagcctggaccttccagctacgacttccaccagctgaagaaattcctgaagatcgccctggaaacccctgccagaatctgccctatcaactacagcctgctggcctccctgctgcccaagggctaccctggcagagtgaacgagatccttcatatcctgatccagacacaggctcagatcccctctaggcccgctccacctcctccaagcagcccaacccacgatcctcctgatagcgaccctcagatccccccaccatacgtggagcccaccgcccctcaagtgctgccagtgatgcacccccacggcgcccctcctaatcacagaccttggcagatgaaagacctgcaggccatcaagcaggaagtgtcccaggccgctcctggcagcccccaatttatgcagaccatcagactcgccgttcagcagttcgaccccacagccaaggatctgcaggacctgctgcagtacctgtgtagcagcctggtcgccagcctgcaccatcagcaactggattctctgatcagcgaggccgagacaagaggcatcaccggctacaaccctctggccggccccctgcgggtgcaggcaaacaacccccagcagcaggggctgcggagagagtaccagcagctgtggctggctgctttcgccgcactgcctggaagcgccaaagatccatcttgggcctctatcctgcagggcctggaagaaccttaccacgcctttgtggaaagactgaacatcgccctggacaacggcctgcctgagggcacccctaaggaccccatcctgagatctctggcctacagcaacgccaacaaggaatgtcagaagctgctgcaagccagaggccacaccaacagccccctgggcgacatgctgcgcgcctgccagacctggacccctaaggacaagaccaaggtgctggtggtgcagcctaagaagcctccccctaatcagccctgcttccggtgcggcaaggccggacactggagccgggactgcacccagcctcggcctccaccgggaccttgtcctctgtgccaagaccccacacactggaagagagattgcccccgcctaaagcccactatcccagaaccagagccagaggaagatgccctcctattagacctccccgctgacattccacacccaaaaaactccatagggggggaggtttaacctctcctcctaccctgcagcaggtgttcctgaatcaagatcctgccagcatcctgcctgtgatccccctcgaccccgctagaagacctgtgatcaaggcccaggtggacacacagacctcccaccccaaaacaatcgaggccctgctggacaccggcgctgatatgacagtgctgccaatcgccctgttcagcagcaacacccctctgaaaaacaccagcgtgctcggagccggcggacagacccaggaccacttcaagctgacaagcctgcctgtcctgatccggctgcccttcagaaccacacctatcgtgctgaccagctgcctggtggacacaaagaacaactgggccatcatcggcagggacgccctgcaacagtgccagggcgtgctgtacctgccagaggccaagggcccccccgttatcctgcctatccaggcccctgccgtgctgggcctggaacacctgccaagacccccccagatcagccaatttcctctgaaccagaacgccagcagaccatgtaatacctggtccggcagaccttggcggcaggccatttctaaccccacccccggccaggagatcacccagtacagccagctgaagcggcctatggaacctggagattctagcaccacctgcggccctctgacactgtgaccatagacctctcatcatcttcccccgggccccctgacttgtccagcctgccaaccacacggtgcccctcaagtgctgccagtgatgcacggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1097 - DNA, 5244 bp, synthetic construct
  misc_feature 1..5244: note = pXDP47 sequence
  source 1..5244: mol_type = other DNA
atgggcaatagctcctctaccccccctccaagcgccctgaagaactccgatctgttcaagaccatgctgaggacacagtacagcggctccgtgaagacacggagaatcaaccaggatatcaagaagcagtatccactgtggccagaccagggaacctgcgcaacaaagcactgggagcaggccgtgctgatccccctggactctgtgagcgaggagaccgccaaggtgctgaatttcctgcgggtgaagatccaggccagaaagggagagaccgcaaggcagatgaccgcacacacaatcaagaagctgatcgtgggcacaatcgataagaacaagcagcagaccgagatcctgcagaagacagacgagagcgatgaggagatggacaccacaaataccatgctgtttatcgcccgcaacaagagggagaggatcgcacagcagcagcaggcagatctggcagcacagcagcaggtgctgctgctgcagagggagcagcagagggagcagagagagaaggatatcaagaagcgggacgagaagaagaagaagctgctgcccgacaccacacagaaggtggagcagaccgatatcggagaggccagctcctctgacgcctccgcccagaagccaatctctaccgacaacaatcccgatctgaaggtggacggcgtgctgacaagaagccagcacaccacagtgccttccaacatcaccatcaagaaggatggcacatccgtgcagtaccagcaccccatcaggaactatcctaccggcgagggcaatctgacagcccaggtgcggaacccttttagaccactggagctgcagcagctgaggaaggactgccccgccctgcctgagggcatcccacagctggccgagtggctgacccagacaatggccatctacaattgtgacgaggccgatgtggagcagctggccagagtgatcttcccaacccctgtgaggcagatcgcaggcgtgatcaacggacacgcagcagcaaataccgcagccaagatccagaactacgtgacagcatgcaggcagcactatccagccgtgtgcgattggggcaccatccaggcctttacatacaagccccctcagaccgcccacgagtatgtgaagcacgccgagatcatcttcaagaacaatagcggactggagtggcagcacgcaaccgtgccttttatcaatatggtggtgcagggcctgccacccaaggtgacacggtccctgatgtctggcaacccagattggagcaccaagacaatcccacagatcatccccctgatgcagcactacctgaatctgcagtccagacaggacgccaagatcaagcagacccctctggtgctgcagctggccatgccagcccagacaatgaacggcaataagggctacgtgggctcctatcctaccaacgagccatactattctttccagcagcagcagaggccagcacccagagcccctccaggcaacgtgccttccaatacctgcttcttttgtaagcagccaggacactggaaggcagactgccctaataagacaaggaacctgcgcaatatgggcaacatgggaaggggaggaagaatgggaggaccaccttaccggagccagccttatccagcctttatccagccaccccagaatcaccagaaccagtataatggcaggatggatcgctctcagctgcaggccagcgcccaggagtggctgccaggaacctaccctgcatgagacccaatcgattgcccctatgagaagagcggcacaaagaccacacaggacgtgatcaccacaaagaatgccgagatcatggtgaccgtgaaccacacaaagatcccaatgctggtggataccggcgcctgtctgacagcaatcggaggagcagcaaccgtggtgccagacctgaagctgaccaacacagagatcatcgcagtgggaatctctgccgagcccgtgcctcacgtgctggccaagccaaccaagatccagatcgagaacacaaatatcgatatcagcccttggtacaatccagaccagaccttccacatcctgggccgcgacacactgtctaagatgcgggccatcgtgagctttgagaagaacggcgagatgaccgtgctgctgcctccaacatatcacaagcagctgtcctgtcagaccaagggtgccgcaaggcagatgaccgcacacacaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1098 - DNA, 4962 bp, synthetic construct
  misc_feature 1..4962: note = pXDP48 sequence
  source 1..4962: mol_type = other DNA
atgggccagacaatcacaacccctctgagcctgaccctggaccactggagtgaagtgcgggctagagcccacaaccagggcgtggaagtccggaaaaaaaagtggatcaccctgtgcgaggccgagtgggtcatgatgaacgtgggatggcctagagagggtacatttagcctggacaacatcagccaggttgagaaaaagattttcgctcctggcccttacggccatcctgaccaggtgccttacatcaccacatggcggagcctggctaccgacccaccaagctgggtgcggcccttcctgcctcctcccaagccccccacccctctgcctcagcctctgagcccccagccctctgcccctctgaccagctctctgtaccctgtgctgcctaagtccgatccccctaaacctcctgttttacctcccgaccctagcagcccactgatcgacctgctgacggaagaacctcctccttatcctggcggacatggccccccaccttctggccctcggaccccaaccgcctcccctatcgcctctagactgagagagcggagagaaaaccccgccgaagagtcccaagccctgcccctgagagagggccctaacaaccggcctcagtactggcccttcagcgccagcgatctgtataactggaagtcccacaatcctcctttcagccaggatcctgtggccctgacaaacctgatcgagtctatcctggtgactcaccagccaacctgggatgactgccagcagctgctgcaggccctcctgaccggcgaagagagacagagagtgctgctggaggccagaaagcaggtgcctggagaggacggcaggcctacccagctgcctaatgtgatcgacgagacattccccctgaccagaccaaattgggacttcgccaccccagctggcagagagcacctgcgcctgtaccggcagcttctgctggccggactgagaggcgctgccagaagaccaaccaacctggctcaggtgaagcaggtcgtgcagggcaaagaggagacacccgccgctttcctggaacggctgaaggaggcctacagaatgtacaccccttacgaccccgaagatccaggacaggccgccagcgtgatcctgagcttcatctaccagagcagccctgacatcagaaacaagctgcagcggctggaaggcctgcagggcttcacactgagcgacctgctcaaggaggccgagaagatctacaacaagcgggaaacccctgaggaaagagaagagagattgtggcagcggcaagaggagcgggacaaaaagcggcacaaggaaatgaccaaggtgctggctaccgtggtggcccagaacagagataaagacagagaggaatcgaagctgggcgaccagagaaagatcccccttggcaaggaccaatgtgcctactgcaaggaaaaaggccactgggtgagggactgtcccaagagacccagaaagaagcccgcaaacagcacactgctgaacctgggcgatcaggagagccaaggccaggacccccctcctgagcctagaatcaccctgaagattggaggccagcctgtgacctttctggtggacaccggcgcccaacactctgtgctgaccagacctgatggccccctcagcgatagaaccgccctggtccagggagctacaggcagcaagaactacagatggaccaccgacagaagggtgcagctggctactggcaaggtgacacacagctttctgtacgtgcccgagtgcccttaccccctcctgggcagagatctgttgacaaagctgaaggcccaaatccacttcaccggagagggcgctaatgtggtgggccccaagggcctgcctcttcaggtgctgacactgcaactggaagagggtgccagctctctgtaccctgtgctgcctggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1099 - DNA, 5061 bp, synthetic construct
  misc_feature 1..5061: note = pXDP49 sequence
  source 1..5061: mol_type = other DNA
atgggccagaccgtgaccacacccctgtccctgacactgggccactggaaggacgtggagcggatcgcccacaatcagtctgtggatgtgaagaagcggagatgggtgaccttctgcagcgccgagtggcccaccttcaacgtgggctggccaagggacggcaccttcaaccgcgatctgatcacacaggtgaagatcaaggtgtttagcccaggacctcacggacacccagaccaggtgccttatatcgtgacctgggaggccctggccttcgatccacctccatgggtgaagccatttgtgcacccaaagccacctccaccactgcctccatccgccccttctctgccactggagccacctcggtccaccccaccaagaagctccctgtatcctgccctgacaccatctctgggcgccaagccaaagccacaggtgctgtctgacagcggaggacctctgatcgacctgctgaccgaggatcctccaccctacagagatccaaggcctccaccatccgacagggatggaaacggaggagaggcaacaccagcaggagaggcccctgacccatcccccatggcctctagactgaggggcaggcgcgagcctccagtggcagatagcaccacatcccaggcattcccactgagggcaggaggaaatggccagctgcagtattggcccttttctagctccgacctgtacaactggaagaacaataacccatccttctctgaggatcccggcaagctgaccgccctgatcgagagcgtgctgatcacccaccagcccacatgggacgattgtcagcagctgctgggcaccctgctgacaggcgaggagaagcagcgggtgctgctggaggcaaggaaggccgtgagaggcgacgatggcagacccacccagctgcctaatgaggtggacgcagcatttccactggagaggccagactgggattataccacacaggccggcaggaaccacctggtgcactacaggcagctgctgctggccggactgcagaatgcaggcaggtcccctaccaacctggccaaggtgaagggcatcacacagggccctaatgagagcccatccgcctttctggagcgcctgaaggaggcctaccggagatataccccctacgaccctgaggatccaggccaggagacaaacgtgtctatgagcttcatctggcagtctgccccagacatcggaaggaagctggagcgcctggaggacctgaagaataagaccctgggcgatctggtgcgggaggcagagaagatcttcaacaagagagagacacctgaggagagggaggagcggatcaggagggagaccgaggagaaggaggagcggagaaggacagaggacgagcagaaggagaaggagcgggatcgccggagacacagagagatgagcaagctgctggccaccgtggtgtccggacagaagcaggacaggcagggaggagagaggcgccggtctcagctggaccgcgatcagtgcgcctactgtaaggagaagggccactgggccaaggattgccccaagaagcctagaggcccaaggggccctaggccacagaccagcctgctgacactggacgattgaggaggacagggacaggagccacctccagagcccagaatcaccctgaaggtcggcggccagcctgtgacctttctggtggacacaggcgcccagcacagcgtgctgacccagaatcccggccctctgtctgataagagcgcctgggtgcagggagcaacaggcggcaagcggtacagatggaccacagaccggaaggtgcacctggccaccggcaaggtgacacacagctttctgcacgtgcccgactgtccataccccctgctgggcagagatctgctgaccaagctgaaggcacagatccacttcgagggatccggagcacaggtcatgggaccaatgggacagcctctgcaggtgctgacactgaacatcgaggatgagggtgccagctccctgtatcctgccctgacaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1100 - DNA, 4757 bp, synthetic construct
  misc_feature 1..4757: note = pXDP50 sequence
  source 1..4757: mol_type = other DNA
atggtgtctctggacagggatatggcaaggcaggtgagcggaggcaagagggattacccagagctggagaagtgcatcaagcacgcctgtaagatcaaggtgcggctgagaggagagcacctgaccgagggcaactgcctgtggtgtctgaagacactggactatatgttcgaggatcacaaggaggagccctggaccaaggtgaagtttagaacaatctggcagaaggtgaagaacctgacccctgaggagagcaataagaaggacttcatgtccctgcaggccacactggccggcctgatgtgctgtcagatgggcatgaggccagagaccctgcaggacgccatggccacagtgatcatgaaggatggcctgctggagcaggaggagaagaaggaggataagcgcgagaaggaggagagcgtgtttccaatcgtggtgcaggcagcaggaggccggtcctggaaggccgtggactctgtgatgttccagcagctgcagaccgtggcaatgcagcacggactggtgagcgaggattttgagagacagctggcctactatgccaccacatggacatccaaggacatcctggaggtgctggccatgatgcccggcaacagagcccagaaggagctgatccagggcaagctgaatgaggaggccgagaggtggcggagaaacaatccacctccaccagcaggaggaggactgaccgtggatcagatcatgggagtgggacagacaaaccaggcagcagcacaggcaaatatggaccaggccagacagatctgcctgcagtgggtcatcaacgcactgagggccgtgagacacatggcacacaggcccggcaaccctatgctggtgaagcagaagaccaatgagccttacgaggacttcgccgccagactgctggaggccatcgatgccgagccagtgacacagcccatcaaggactacctgaagctgaccctgagctatacaaatgcctccgccgactgccagaagcagatggatagaaccctgggacagagggtgcagcaggcctccgtggaggagaagatgcaggcctgtagggatgtgggctctgagggctttaagatgcagctgctggcccaggccctgaggcctggcaagggcaagggaaacggacagccacagcggtgctacaattgtggcaagccaggacaccaggcaaggcagtgcaggcagggcatcatatgtcacaactgtggaaagagaggacatatgcaaaaagaatgcagaggaaagagagacataaggggaaaacagcagggaaacgggaggagggggatacgtgtggtgccgtccgctcctcctatggaataacaagcgcccctccaatggtgcaggtgcggattggatctcagcagcgcaacctgctgttcgacaccggcgccgatagaaccatcgtccggtggcacgagggctccggcaaccccgccggcagaatcaaactgcaaggcatcggcggaatcgtggaaggcgagaagtggaacaacgtggagctggaatacaagggcgagacaagaaagggcaccatcgtggtgctgcctcagagccctgtggaggtgctgggacgggacaacatggcccggttcggcatcaagatcatcatggctaatctggaggaaaaaagaatccccatcaccaaggtgaagttgaaagagggatgtggtgccgcaggaggccggtcctggaaggccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1101 - DNA, 4821 bp, synthetic construct
  misc_feature 1..4821: note = pXDP51 sequence
  source 1..4821: mol_type = other DNA
atgggcgatcctctgacatggagcaaggccctgaagaagctggagaaggtgaccgtgcagggcagccagaagctgaccacaggcaactgcaattgggccctgtccctggtggacctgttccacgatacaaactttgtgaaggagaaggattggcagctgcgcgacgtgatcccactgctggaggacgtgacccagacactgtctggccaggagcgggaggccttcgagagaacctggtgggccatcagcgccgtgaagatgggcctgcagatcaacaatgtggtggatggcaaggcctcttttcagctgctgagggccaagtacgagaagaagacagccaacaagaagcagtctgagcctagcgaggagtatccaatcatgatcgacggcgccggcaaccggaatttcagaccactgacccccagaggctacaccacatgggtgaacacaatccagaccaacggcctgctgaatgaggcctcccagaatctgttcggcatcctgagcgtggattgtacctccgaggagatgaatgcctttctggacgtggtgccaggacaggcaggacagaagcagatcctgctggacgccatcgataagatcgccgacgattgggataaccggcacccactgcccaatgcacctctggtggcaccacctcagggacctatcccaatgacagccaggtttatcaggggactgggagtgccacgggagagacagatggagcccgccttcgaccagtttaggcagacctaccgccagtggatcatcgaggccatgagcgagggcatcaaagtgatgatcggcaagccaaaggcacagaacatcaggcagggagccaaggagccctatcctgagttcgtggatagactgctgtcccagatcaagtctgagggccaccctcaggagatctccaagtttctgaccgacacactgaccatccagaacgccaatgaggagtgccggaatgccatgcggcacctgagaccagaggataccctggaggagaagatgtacgcctgtagagacatcggcaccacaaagcagaagatgatgctgctggccaaggccctgcagacaggcctggccggaccattcaagggaggcgccctgaagggcggccccctgaaggccgcccagacctgctataactgtggcaagccaggacacctgagctcccagtgcagggcaccaaaggtgtgcttcaagtgtaagcagcctggccacttttctaagcaatgcagaagtgttccaaaaaacgggaagcaaggggctcaagggaggccccagaaacaaactttcccgatacaacagaagagtcagcacaacaaatctgttgtacaagagactcctcagactcaaaatctgtacccagatctgagcgaaataaaaaaggaatacaatgtcaaggagaaggatcaagtagaggatctcaacctggacagtttgtgggagtaaacatataacctggagaagcgccccaccacaatcgtgctgatcaacgacacccctctgaacgtgctgctggacacaggagctgatacatctgtgctcaccaccgcccactacaaccggctgaagtacagaggcagaaagtaccagggcaccggcatcatcggcgtgggcggaaatgtggaaaccttcagcaccccagtgaccattaagaaaaagggccggcacatcaaaaccagaatgctggtcgccgacatccctgtgacaatcctgggcagagatatccttcaggacttaggtgcaggtgccagcgaggagtatccaatcatgatcggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1102 - DNA, 4871 bp, synthetic construct
  misc_feature 1..4871: note = pXDP52 sequence
  source 1..4871: mol_type = other DNA
atgggcgccaggaacagcgtgctgtccggcaaggaggccgatgagctggagaaggtgcggctgagacccaatggcaagaagaagtacatgctgaagcacgtggtgtgggcagcaaacgagctggaccgcttcggcctggccgagtctctgctggataataaggagggctgccagaagatcctgagcgtgctggcccctctggtgccaaccggctctgagaacctgaagagcctgtataatacagtgtgcgtgatctggtgtatccacgccgaggagaaggtgaagcacaccgaggaggccaagcagatcgtgcagaggcacctggtggtggagaccggcacagcagataggatgccagccaccagccgcccaacagcaccaccttccggaaggggcggcaactaccccgtgcagcaagtgggcggcaattatgtgcacctgcccctgagccctagaaccctgaacgcctgggtgaagctggtggaggagaagaagttcggagcagaggtggtgccaggatttcaggccctgtccgagggctgcacaccctacgacatcaaccagatgctgaattgcgtgggagagcaccaggcagcaatgcagatcatccgggagatcatcaacgaggaggcagcagactgggatctgcagcaccctcagccaggaccactgcctgcaggacagctgcgggagcctagaggctctgacatcgccggcaccacaagcaccgtggatgagcagatccagtggatgtacaggcagcagaacccaatccccgtgggcaatatctatcggagatggatccagctgggcctgcagaagtgcgtgcggatgtataacccaaccaatatcctggacgtgaagcagggcccaaaggagcccttccagagctacgtggacagattctacaagtccctgagagccgagcagacagatcccgccgtgaagaactggatgacccagacactgctgatccagaacgccaatcccgattgcaagctggtgctgaagggcctgggcatgaatcctaccctggaggagatgctgacagcatgtcagggagtgggaggacctggacagaaggcaaggctgatggcagaggccctgaaggaggccctgaggcctgaccagctgccatttgccgccgtgcagcagaagggccagaggaagaccatcaagtgctggaactgtggcaaggagggacactctgccaagcagtgcagggcaccaaggcgccagggatgctggaagtgtggcaagacaggccacgtgatggccaagtgtcctgagaggcaggcaggcttcctgggactgggaccatggggcaagaagccaagaaattttcctatggcccagatgcctcagggactgatcccaaccgcaccaccagaggacccagcagtggatctgctgaagaactacatgaagatgggcaggaagcagcgcgagaatagggagcgcccttataaggaggtgacagaggacctgctgcacctgaactctctctttggagaagaccagtagttacagcctacatcgaggaacagcctgtggaagtgctgctggatacaggagctgatgacagcatcgtggccggcattgagctgggacctaactacaccccaaagatcgtgggcggcatcggcggattcatcaataccaaagagtacaaggacgtgaagatcaaagtgctgggcaaggtgatcaagggcaccatcatgaccggcgacacacccatcaacatcttcggcagaaacctgctcaccgccatgggcatgtctctgaacctgcctatcgccaaggtcgagggtgccggcggcaactaccccgtgcagcaaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1103 - DNA, 4700 bp, synthetic construct
  misc_feature 1..4700: note = pXDP53 sequence
  source 1..4700: mol_type = other DNA
atggccaagcagggctccaaggagaagaagggctaccccgagctgaaggaagtgatcaaggcaacctgcaagatcagggtgggacctggcaaggagaccctgacagagggcaactgtctgtgggccctgaagacaatcgacttcatctttgaggatctgaagaccgagccatggaccatcacaaagatgtatacagtgtgggatcggctgaagggactgaccccagaggagacatccaagagagagttcgcctctctgcaggccaccctggcctgcatcatgtgctcccagatgggcatgaagcctgagacagtgcaggccgccaagggcatcatctctatgaaggagggcctgcacgagaataaggaggccaagggcgagaaggtggagcagctgtaccctaacctggagaagcacagggaggtgtatccaatcgtgaatctgcaggcaggaggccgcagctggaaggcagtggagtccgtggtgttccagcagctgcagaccgtggccatgcagcacggcctggtgtctgaggactttgagcggcagctggcctactatgccaccacatggacaagcaaggatatcctggaggtgctggccatgatgccaggcaacagagcccagaaggagctgatccagggcaagctgaatgaggaggcagagcggtgggtgagacagaacccacctggacccaatgtgctgaccgtggaccagatcatgggcgtgggccagacaaaccagcaggccagccaggccaatatggatcaggccaggcagatctgcctgcagtgggtcatcaccgccctgaggagcgtgcgccacatgtcccacaggcctggaaacccaatgctggtgaagcagaagaatacagagtcctacgaggacttcatcgccaggctgctggaggcaatcgacgcagagcccgtgacagatcctatcaagacctacctgaaggtgaccctgtcttatacaaacgccagcaccgactgccagaagcagatggataggaccctgggaacacgcgtgcagcaggcaaccgtggaggagaagatgcaggcctgtcgggatgtgggctctgagggctttaagatgcagctgctggcccaggccctgagacctcagggcaaggcaggacagaagggagtgaaccagaagtgctacaattgtggcaagccaggacacctggcaaggcagtgcagacagggaatcatctgccaccactgtggcaagaggggccacatgcagaaggactgtcgccagaagaagcagcagggcaacaataggagaggaccaagggtggtgccatctgccccaccaatgctgtgacagaggcccctcctaagatcgagatcaaggtgggcacaagatggaagaaactgctggtcgacaccggcgctgataagaccatcgtgaccagccacgacatgagcggcatccccaagggcagaatcatcctgcagggcattggaggaatcatcgagggcgagaagtgggagcaggtgcacctgcagtacaaggacaagatcatccggggcaccatcgtggtgctcgccacatctccagtggaagtgctgggaagagataacatgcgggaactgggcatcggcctgatcatggctaacctggaagagaaaggtgccagggaggtgtatccaatcgtgaatggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1104 - DNA, 5479 bp, synthetic construct
  misc_feature 1..5479: note = pXDP54 sequence
  source 1..5479: mol_type = other DNA
agccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcgccaccatggccctgaatgatttcgaccctatcgccctccagggctacctgccggcccctagagtgctgcaacacaacgacatcatcatctgcagagctacttctggcccctggggcatcggcgacagatacaacctgatcaggatccacctgcaagaccctgccggacagccccttccaatcccccagtgggagcctatccctaaccggaccgccaacccccggacacagccctaccctgtggtgtctgccccaatggctaccctggaaaacatcctgaacaactttcacatcccccacggcgtgtccagatacggccccctggaaggcggagattaccagcctggcgaacagtacagccaaggcttctgccctgtgacccaggccgagattgccctgctgaacggccagcacctggaagaagagatcacaatcctgagagagatcacccacagactgatgcagggcgtgcggcctcctgccgtgcctcagggccctgctcctcctcctcctccagctcagcctcctgctcccctgcctgctccaccaattgggcctccacctcccgctgcccctgcccccgccccaggccccatgcctgtgccccagcatctgcctattacacatatcagagccgtgatcggcgaaacccccgccaacatccgcgaggtgccactgtggctggctagagccgttcccgccctgcagggagtgtaccccgtccaggacgccgtgatgagaagccgcaccgtgaacgccctgaccgtgcggcaccctggactggccctggaacctctggagtgcggcagctggcaagagtgtctggccgccctgtggcagagaaccttcggcgccaccgccctgcacgccctgggcgataccctgggtcagatcgcaaacagcgacggcatcgtgatggctatcgagctgggcctgctcttttccgatgataactgggacctggtgtggggaatctgtagaagattcctgcccggccaggccgtctgcgtggccgtgcaggccagactggatcccctgcccgacaacgctacaagaatcgtgatgatcagccacatcatccgggacgtgtacgccatcctgggcctggaccctctgggcagacccatgcagcagacactgcctagacggaacaaccagcctcccagacagcagccacagagacggcagcagcctagaagaaccggcaaccaggaggaaagaggccagcggaaccggggccggcagaacgcccagacccctcggcaggagggcaacagactgcagaacagccagctgcctggccctcgcgactgccccaacaatagcaaccagcctcggtaccctctgcggccaaacccccagcagccccaaagatacggccaggagcagaatcgtggcaacaatcccaacccttacagacaacctacccctggcaatggaaatcaaaacagaaacttcagccgggggcctgccccagtcaatgagcagagcagaggcagaggaagatctagccagggtacaaataacaccggctcctctgctgtgcacagcgtgcggctgaccagcgccgcccctcctatacccccacaagatgccggcactccgcccacttcaagtggaaatcaagggcaatcatcttaaaggctactgggacagcggcgccgagatcacatgcgtgcccgctatctacatcatcgaggaacaacctgttggcaagaagctgattacaaccatccacaacgagaaggaacatgatgtgtactacgtggaaatgaaaatcgagaagcggaaggtgcagtgtgaagtgatcgccaccgccctggattacgtgctggtggcccctgtggacatcccctggtataagcctggacctctggaactgaccatcaagatcgacgtcgagagccagaagcacaccctgatcacagagtccaccctctctccacagggccagatgagactgaagaaactgctggaccagtaccaggccctgtggcagtgctgggagaaccaggtgggccacagaagaggtgcctctgctgtgcacagcgtgcggctgggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1105 - DNA, 5764 bp, synthetic construct
  misc_feature 1..5764: note = pXDP55 sequence
  source 1..5764: mol_type = other DNA
agccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcgccaccatgagccagccctccgcttctggcagcgccggcgccggaggcgcccctcagcaacctcctcctccacctccccagcccggacctgccgcccccgtgcctagagcccagatcggttatggagatctggacgtgcttctgctgcaacaggagtaccacctcatcgatcctaatctgcaagtgcaacacctggacaccctgctggtgagaatcacaggcggaaactggggccctggcgatagattcgccagaatcgaggtgctgctccgcgacacactgggccctctgcaacagcctagatacagatacgccgccatgcagcaggccgacctgagaaacgacatcatcctgcacctgaactaccaggatgccatcatcatcttcgacatgatcatccccagcgagggcgtgcaccggcacggccctatgtttgacggcctgtggatccacggcgacgactacagcatgaacttccagcctatcacagcccacgagctgtacctgctgcctcagcaggtgctgaccgaggaagtggaactgctcaccgaggtgtgcaacagaatggccgattggatccggcggcacaggtgtggcggaggaagcggctcctctcagccacctcctcccccacctccagccgtgccagtgctgcctagtgcccctccagccagcagcctgcccctgcccccacagggctggggcatctctcctcccgtggctaccagcacccctggcgctgccggacattctagcagcgccggtcctaacatcagcctgggcggcacctacgtgccccctcctgtggctcctccagcccctgtgatcggcggccctggcggacccggacagctgcctgctatggtgcaggtgctgcccgctcaacctgtcgtgatccccattaacgtgatcagatctgtgtgcggcgatacacctagcaaccctcaagacatccctctgtggatgggcagaatcatccccgccattgagggcgtctttcctattgacaaccccaatctgagaatgagagtggtgaacgccctgctggctctgcatcctggcctggctatcaccgaactgaatgcccagacatggggccaggttctggctgtgctgcacatgcgggccctgggacacaccgccctgcaccagctgcctgccctgctggaaacaatcgtgaagaccgacggcatcctgccagcttataacatgggcatggaagttacacagcaggatttcagctacgtgtggggcatcctgcggacactgttgcccggccaagccttcgtgctgagcatgcagaacgagctggaccggctgcctgccgcccagagacctggaatgttccccggcctgctgcagagaaccctggatatcctgggcctgaacagcagaggacagaacatccagaaaaccaacacccagcagcaggccccaaagcggggccagaagcctaagcccagactgcccccagtgcacagacggcctgcacccttcacccctcctgccacccccagccctcggcagcaggccagcgccagccccagcagccagggcgacaacagaagccctcagcctcagggcagaggcacatacggcccgagccggggaggcggctctggccctagatacaacttccgtcccagagtgcagcctcccgacagatacggcttcggcagaggccagggaggcagaagcagcatcggcgcccaggacaatcagcagcccggacaaggcggacagcggacccagcagaccaaccagaaccgcaaccagggcaacgccaccggcggtagaacccagcctcagaatagaacagtgaacaccgtgcgggtgacccagaccaatcctcaaggcggctcctccgtgtccaacccagctgtgacaacttctcagaatacaggaacaggaagtgcaactcagagctcatcatcttaaaggctttgtggacacaggcagcagcatcacctgcttccccaagtacaccctggtcgaggaagatcctatcggccagtacgacatcagcaccatccacggcacagtgtcccagcctgtgtactacatcaagttcaaggtgaacggcaagaaagtggaagccgaggtgaccgagtctccactggactacgtgatcctgtgtcctagcgacgtgccctggctgtctacaaagctggaactgacaattaagctgcctctgcaccagcagcaacaggagctgctgagcaagaccagagtgaatcaaaaacagctgcagaaactctttatccagtatgatgacctgtggcagaagtgggagaaccaggttggacaccggaagggtgccagaacagtgaacaccgtgcgggtgggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1106 - DNA, 5404 bp, synthetic construct
  misc_feature 1..5404: note = pXDP56 sequence
  source 1..5404: mol_type = other DNA
atggcctctggcagcaacgtggaggaatacgagctggatgtggaagccctggtggtcatcctgcgggacagaaacatcggaagaaatcccctgcacggcgaaatcatcggcctgagactgaccgagggctggtggggccagatcgagagatttcagatggtgcggctgatcctgcaggacgacgacaacgagcccctgcagagaccccgctacgaggtgatccccagagccgtgaacccccacaccatgttcatgatcagcggccccctggctgaactgcagctggccttccaggacctggacctgcccgagggccctctgcggtttggcccgctggctaacggccactacgtgcagggggatccttacagcagcagctaccggcccgtgaccatggccgaaacagcccagatgaccagagatgagctggaagatatcctgaacacccaaagcgagatcgagatccagatgatcaacctgctggaactttatgaggtggaaaccagagccctgagaagacagctggccgagagaagcagcatcggccagggaggagtgagccccggcgctccaaggccgagacctccagttagcagcttcagcggcctgcctagcctgccttctatccccggcatccaccccagagccccttcccctcctcgcgctacaagcacccctggtaacatcccctggtccctgggagatgacagcccacctagctcgtcttttcctggccctagtcagcctagagtgtctttccaccctggcaatcctttcgtggaggacgagggacatagacctagatcccagagccgggaaagacggagaaacaatcctcctgcccctatccctagcgcccctccaatgatccaatacgtgcccgtgcctcctccacctcctgtcggaaccgtgatacctatccaacacatccggtccgtgaccggcgagcctccaaagaacccccgagaaatccccatctggctgggccggaatgcccctgctatcgacggcgttttccccgtgacgaccccagacctgcggtgcagaatcatcaacgccattctgggaggcaacctgggcctgagcctgacacctgccgactgtgtgacctgggactctgccgtgggcaccctgttcgtgcggacacacggacagttccctatgcaccagctgggcacagtgatccagggcatcgtgaaccaggagggcgtggctaccgcttatacactgggcatgatgctgagcggccagaattaccccctcgtgagcggcatcatcagaggctacctgcccggccaggccgtggtgaccgcccttcagcagcgcctggaccaggaggtggatgaccaggccagggctgaaaccttcatccagcacctgaacgctgtgtacgagatcctgggcctcaacgccagaggacaatctatcagagccagcgtgacaccgcaacctcggccaagccggggccgcggcagaggccagtctacacctagaccttcccagggccctgtgagttcaggacggggcagacagcggcctgccagcggccagtacgacagaggcagcaacaaccagaaccaagaccagggtaacaccagccagggcggctacaacctgagaccaagaacctaccagcctcagagatacggcggcggaagaggtcggagatggaacgagaacaccaacagccaggagagcagacccagcgatcagggctcccagacaccccggcctaaccaagctggcagcggcgtcagaggcaaccagagccagacccctagacccgccgccggcagaggaggcagaggcaatcagaatagaaaccagcggtctagcggagccggcgatagcagagccgtcaacacagtgacccagagtgccacgtcctccacagatgaatcctcttcagctgttgcaaccgcttccagcggagatcaaaggaactaaactgttagcccattgggacagcggcgccaccattacatgcgtgcccgagtccttcctggaagatgagcagcctatcaaacagaccctgatcaagacaatccacggcgagaagcagcagaaagtgtactacctgacctttaagatcaagggaagaaaggtggaagctgaagtgatcgccagcccttacgagtacatcctgctgtctccaacagacgtgccttggctgacacagcaacctctgcagctgaccatcctggtccccctgcaggagtatcaggatagaatcctcaacaagaccgccctgcctgaggaacagaagcaaagactgaagaccctgttcgccaagtacgacaccctgtggcagcactgggagaaccaggtgggccaccggcggggtgccagagccgtcaacacagtgacccagggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1107 - DNA, 4794 bp, synthetic construct
  misc_feature 1..4794: note = pXDP127 sequence
  source 1..4794: mol_type = other DNA
atggaagccgtgatcaaggtgatcagctccgcatgcaagacctactgtggcaagacgagcccaagcaagaaggaaatcggcgctatgctgagcctgctgcagaaggagggcctcctgatgagcctgtctgatctgtacagcccaggtagctgggaccctatcaccgccgccctgacacagagagccatggtgctgggcaaaagcggcgagctgaagacatggggactggtgctgggcgccctgaaagccgctagagaagagcaagtaaccagcgagcaggccaagttctggctgggactgggcggcggtagagtgagcccccctggccctgagtgcatcgagaagcctgccaccgagcggcgcattgacaaaggcgaagaagtgggcgagacaaccgtgcagagagacgccaagatggctccagaagagacagcaaccccaaagaccgtgggcaccagctgctaccactgcggcaccgctatcggctgcaactgcgccaccgccagcgcgcctcctcccccgtatgtgggcagcggcctctacccctccctggcaggagtgggagagcagcagggccagggcggagatacacccagaggcgccgagcagcctagagccgaacccggccacgccggccaggcccctggccccgccctgaccgactgggccagaatcagagaggagctggcctctacaggccctccagtggtcgccatgcctgtggtgatcaagaccgagggacctgcctggacccctctggaacctaaactgattacacggctggctgataccgtcagaaccaagggcctcagaagccccatcacaatggccgaagtggaagccctgatgagcagcccactgctgcctcacgacgtgaccaacctgatgcgggtgatcctgggccccgccccttacgccctgtggatggacgcctggggcgtgcagctgcaaacagttatcgccgccgccacaagagacccccggcacccagccaacggccagggcagaggcgagagaacaaacctggatcggctgaagggcctcgccgatggcatggccggcaatcctgagggccaggctgctctgctgagacccggggaactggttgctatcaccgccagcgccctgcaggccttcagagaagtggcccggctggccgagcctacagacccctgggccgagatcacccagggcccttctgagagcttcgtggacttcgccaacagactgatcaaggccgttgagggctccgacctgcctcctagcgcccgcgcccccgtgatcatcgactgttttagacagaaatcgcaacccgacatccagcagctgatccgggccgctccttctaccctgaccacacctggcgagatcatcaagtacgtgctggacagacagaagaccgcccccctgaccgacagaggaatcgccgccgccatgtctagcgccattcagcctctggtgatggccgtggtcaacagagaaagagatggacagacaggttctggcggcagagcccggggcctgtgctacacctgcggatcccctggacactaccaggcccagtgtcctaagaaaagaaagtctggtaacagcagagagcggtgccagctgtgtgatggcatgggccacaacgccaaacagtgccggagacgggacggaaaccaaggacaaagacccggccggggactgagcagcggaccttggcctgtcagccagcaacctgccgtgtccggtgccaccagctgctaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1108 - DNA, 4320 bp, synthetic construct
  misc_feature 1..4320: note = pXDP128 sequence
  source 1..4320: mol_type = other DNA
atgggcaactctcctagctacaatccccctgccggcatctccccatctgactggctgaacctgctgcagtccgcccagcgcctgaatccaaggcctagcccatccgacttcacagatctgaagaactatatccactggtttcacaagacccagaagaagccttggaccttcacaagcggaggaccaacatcctgcccaccaggcagatttggaagggtgccactggtgctggccaccctgaacgaggtgctgtccaatgagggaggagcacctggagcctctgccccagaggagcagcctccaccctacgaccctccagccatcctgcccatcatctccgagggaaacaggaataggcacagggcatgggcactgagggagctgcaggatatcaagaaggagatcgagaataaggcccctggctctcaagtgtggatccagacactgcggctggccatcctgcaggcagacccaacccctgcagatctggagcagctgtgccagtacatcgccagccctgtggaccagaccgcccacatgacatccctgaccgcagcaatcgcagcagcagaggcagcaacacccagcagagtgctgacccctaagaccggcacactgacccagcagtctgcccagccaaacgcaggcgatctgaggagccagtatcagaatctgtggctgcaggccggcaagatctccctgctggtgctgcagctgcagccctggtctaccatcgtgcagggacctgcagagagctccgtggagtttgtgaaccgcctgcagatctccctggccgacaacctgccagatggcgtgctgcggaatcccctgctgacacctctggtcatgcagatgctgaccgagtctgtgagcaagttctgcaggggagaggccagcggaaggggaggagccaagacagcaggactgagaaccatcggaccacctaggatgaagcagcctgccctgctggtgcacaccccaggaccaaagatgcctggaccacgccagccagcacctaagaggccaccacctggaccttgctacagatgtctgaaggagggacactgggccagggactgcccaacaaaggcaaccggcccaccacctggaccatgccccatctgtaaggacccaagccactggaagcgcgattgtcccacactgaagtccaagaatctaatagaggggggacttagcgccccccaaaccataacacctataacagattctcttagtgaggccgaattagaatgcttaggtgccccagccatcctgcccatcatctccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1109 - DNA, 4407 bp, synthetic construct
  misc_feature 1..4407: note = pXDP129 sequence
  source 1..4407: mol_type = other DNA
atggtgtctctggacagggatatggcaaggcaggtgagcggaggcaagagggattacccagagctggagaagtgcatcaagcacgcctgtaagatcaaggtgcggctgagaggagagcacctgaccgagggcaactgcctgtggtgtctgaagacactggactatatgttcgaggatcacaaggaggagccctggaccaaggtgaagtttagaacaatctggcagaaggtgaagaacctgacccctgaggagagcaataagaaggacttcatgtccctgcaggccacactggccggcctgatgtgctgtcagatgggcatgaggccagagaccctgcaggacgccatggccacagtgatcatgaaggatggcctgctggagcaggaggagaagaaggaggataagcgcgagaaggaggagagcgtgtttccaatcgtggtgcaggcagcaggaggccggtcctggaaggccgtggactctgtgatgttccagcagctgcagaccgtggcaatgcagcacggactggtgagcgaggattttgagagacagctggcctactatgccaccacatggacatccaaggacatcctggaggtgctggccatgatgcccggcaacagagcccagaaggagctgatccagggcaagctgaatgaggaggccgagaggtggcggagaaacaatccacctccaccagcaggaggaggactgaccgtggatcagatcatgggagtgggacagacaaaccaggcagcagcacaggcaaatatggaccaggccagacagatctgcctgcagtgggtcatcaacgcactgagggccgtgagacacatggcacacaggcccggcaaccctatgctggtgaagcagaagaccaatgagccttacgaggacttcgccgccagactgctggaggccatcgatgccgagccagtgacacagcccatcaaggactacctgaagctgaccctgagctatacaaatgcctccgccgactgccagaagcagatggatagaaccctgggacagagggtgcagcaggcctccgtggaggagaagatgcaggcctgtagggatgtgggctctgagggctttaagatgcagctgctggcccaggccctgaggcctggcaagggcaagggaaacggacagccacagcggtgctacaattgtggcaagccaggacaccaggcaaggcagtgcaggcagggcatcatatgtcacaactgtggaaagagaggacatatgcaaaaagaatgcagaggaaagagagacataaggggaaaacagcagggaaacgggaggagggggatacgtgtggtgccgtccgctcctcctatggaaggtgccgcaggaggccggtcctggaaggccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1110 - DNA, 4521 bp, synthetic construct
  misc_feature 1..4521: note = pXDP130 sequence
  source 1..4521: mol_type = other DNA
atgggcgatcctctgacatggagcaaggccctgaagaagctggagaaggtgaccgtgcagggcagccagaagctgaccacaggcaactgcaattgggccctgtccctggtggacctgttccacgatacaaactttgtgaaggagaaggattggcagctgcgcgacgtgatcccactgctggaggacgtgacccagacactgtctggccaggagcgggaggccttcgagagaacctggtgggccatcagcgccgtgaagatgggcctgcagatcaacaatgtggtggatggcaaggcctcttttcagctgctgagggccaagtacgagaagaagacagccaacaagaagcagtctgagcctagcgaggagtatccaatcatgatcgacggcgccggcaaccggaatttcagaccactgacccccagaggctacaccacatgggtgaacacaatccagaccaacggcctgctgaatgaggcctcccagaatctgttcggcatcctgagcgtggattgtacctccgaggagatgaatgcctttctggacgtggtgccaggacaggcaggacagaagcagatcctgctggacgccatcgataagatcgccgacgattgggataaccggcacccactgcccaatgcacctctggtggcaccacctcagggacctatcccaatgacagccaggtttatcaggggactgggagtgccacgggagagacagatggagcccgccttcgaccagtttaggcagacctaccgccagtggatcatcgaggccatgagcgagggcatcaaagtgatgatcggcaagccaaaggcacagaacatcaggcagggagccaaggagccctatcctgagttcgtggatagactgctgtcccagatcaagtctgagggccaccctcaggagatctccaagtttctgaccgacacactgaccatccagaacgccaatgaggagtgccggaatgccatgcggcacctgagaccagaggataccctggaggagaagatgtacgcctgtagagacatcggcaccacaaagcagaagatgatgctgctggccaaggccctgcagacaggcctggccggaccattcaagggaggcgccctgaagggcggccccctgaaggccgcccagacctgctataactgtggcaagccaggacacctgagctcccagtgcagggcaccaaaggtgtgcttcaagtgtaagcagcctggccacttttctaagcaatgcagaagtgttccaaaaaacgggaagcaaggggctcaagggaggccccagaaacaaactttcccgatacaacagaagagtcagcacaacaaatctgttgtacaagagactcctcagactcaaaatctgtacccagatctgagcgaaataaaaaaggaatacaatgtcaaggagaaggatcaagtagaggatctcaacctggacagtttgtgggagggtgccagcgaggagtatccaatcatgatcggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1111 - DNA, 4674 bp, synthetic construct
  misc_feature 1..4674: note = pXDP131 sequence
  source 1..4674: mol_type = other DNA
atgggccagacccacagcagacaactgttcgtgcacatgctgtccgtgatgctgaagcacagaggcatcaccgtgtctaagcctaagctgatcaacttcctgagcttcatcgaggaagtgtgtccttggtttccacgggaaggcacagtgaacctggaaacatggaaaaaggtgggcgaacagatcagaacccactacaccctgcacggccctgagaaggtgcctgtggaaacactttccttctggaccctgatccgcgactgcctggatttcgacaatgacgagctgaaaagactgggcaacctgctcaagcaggaggaagatcctctgcacgaccctgacagcgagaacagctacgacgcccctcctcctcctcatcctagcctgcactctagcagaccttccgacaacgacgacctgctgtctagcacagacgaggccgagctggacgaggaagccgccaagtaccaccaggaggactggggcttcctggctcaggagaaaggcgccctgacaagcaaggacgagctggtggaatgtttcaagaacctgaccatcgccctgcagaacgctggaatcaagctgccagccaacaacgataagttcccctccgccccccctctgcctcctgcctacgcccctagcgtggtggccggactggatccaccccccggccccctgcccccaagcaagaacatgtctccactgcagaaagccctgagacaagcccagaggctgggcgaagttgtgtccgatttcagcctggccttccccgtgttcgagaacaacaaccagcggtactacgagagcctgcctttcaagcagctgaaggaactcaaaatcgcatgcagccagtacggccctaccgcaccttttaccatcgccatgatcgagaacctcggcacccaggccctgccacctaatgattggaagcagacagccagagcctgcctgtcaggcggagattacctgctgtggaagagcgagttcttcgagcaatgcgccagaatcgctgacgtgaaccggcagcagggcatccagacgagctacgagatgctgatcggcgagggaccctaccaggccaccgacacccagctgaacttcctgcctggggcctatgcccaaatcagcaacgccgccagacaggcttggaagaaactgcctagctcttctacaaagaccgaggacctgagcaaagtgcggcaaggccccgatgagccctaccaggactttgtcgccagactgctcgacaccatcggcaagatcatgagcgacgaaaaggccggcatggtcctggctaagcaactggctttcgagaatgctaatagcgcctgtcaggccgccctgcggccttacagaaagaagggcgacctgtccgattttatcagaatctgcgccgacatcggcccctcttatatgcagggaattgccatggccgctgctctgcagggcaaaagcatcaaggaagtgcttttccagcagcaagctcggaacaagcggggaagacagagaagcggcaatagcggttgttttgtgtgcggccagcccggccaccgcgccgccgtgtgcccccagaagcagcagagccccgtgaacacccctaatctgtgcggtgccgactgcctggatttcgacaatgacggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1112 - DNA, 4569 bp, synthetic construct
  misc_feature 1..4569: note = pXDP132 sequence
  source 1..4569: mol_type = other DNA
atgggccagacaatcacaacccctctgagcctgaccctggaccactggagtgaagtgcgggctagagcccacaaccagggcgtggaagtccggaaaaaaaagtggatcaccctgtgcgaggccgagtgggtcatgatgaacgtgggatggcctagagagggtacatttagcctggacaacatcagccaggttgagaaaaagattttcgctcctggcccttacggccatcctgaccaggtgccttacatcaccacatggcggagcctggctaccgacccaccaagctgggtgcggcccttcctgcctcctcccaagccccccacccctctgcctcagcctctgagcccccagccctctgcccctctgaccagctctctgtaccctgtgctgcctaagtccgatccccctaaacctcctgttttacctcccgaccctagcagcccactgatcgacctgctgacggaagaacctcctccttatcctggcggacatggccccccaccttctggccctcggaccccaaccgcctcccctatcgcctctagactgagagagcggagagaaaaccccgccgaagagtcccaagccctgcccctgagagagggccctaacaaccggcctcagtactggcccttcagcgccagcgatctgtataactggaagtcccacaatcctcctttcagccaggatcctgtggccctgacaaacctgatcgagtctatcctggtgactcaccagccaacctgggatgactgccagcagctgctgcaggccctcctgaccggcgaagagagacagagagtgctgctggaggccagaaagcaggtgcctggagaggacggcaggcctacccagctgcctaatgtgatcgacgagacattccccctgaccagaccaaattgggacttcgccaccccagctggcagagagcacctgcgcctgtaccggcagcttctgctggccggactgagaggcgctgccagaagaccaaccaacctggctcaggtgaagcaggtcgtgcagggcaaagaggagacacccgccgctttcctggaacggctgaaggaggcctacagaatgtacaccccttacgaccccgaagatccaggacaggccgccagcgtgatcctgagcttcatctaccagagcagccctgacatcagaaacaagctgcagcggctggaaggcctgcagggcttcacactgagcgacctgctcaaggaggccgagaagatctacaacaagcgggaaacccctgaggaaagagaagagagattgtggcagcggcaagaggagcgggacaaaaagcggcacaaggaaatgaccaaggtgctggctaccgtggtggcccagaacagagataaagacagagaggaatcgaagctgggcgaccagagaaagatcccccttggcaaggaccaatgtgcctactgcaaggaaaaaggccactgggtgagggactgtcccaagagacccagaaagaagcccgcaaacagcacactgctgggtgccagctctctgtaccctgtgctgcctggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1113 - DNA, 4410 bp, synthetic construct
  misc_feature 1..4410: note = pXDP133 sequence
  source 1..4410: mol_type = other DNA
atgggtcagattttcagcagaagcgcctcccctattcctagacctccacggggcctggccgcccaccactggctgaatttcctgcaggccgcttatagactggagcctggaccttccagctacgacttccaccagctgaagaaattcctgaagatcgccctggaaacccctgccagaatctgccctatcaactacagcctgctggcctccctgctgcccaagggctaccctggcagagtgaacgagatccttcatatcctgatccagacacaggctcagatcccctctaggcccgctccacctcctccaagcagcccaacccacgatcctcctgatagcgaccctcagatccccccaccatacgtggagcccaccgcccctcaagtgctgccagtgatgcacccccacggcgcccctcctaatcacagaccttggcagatgaaagacctgcaggccatcaagcaggaagtgtcccaggccgctcctggcagcccccaatttatgcagaccatcagactcgccgttcagcagttcgaccccacagccaaggatctgcaggacctgctgcagtacctgtgtagcagcctggtcgccagcctgcaccatcagcaactggattctctgatcagcgaggccgagacaagaggcatcaccggctacaaccctctggccggccccctgcgggtgcaggcaaacaacccccagcagcaggggctgcggagagagtaccagcagctgtggctggctgctttcgccgcactgcctggaagcgccaaagatccatcttgggcctctatcctgcagggcctggaagaaccttaccacgcctttgtggaaagactgaacatcgccctggacaacggcctgcctgagggcacccctaaggaccccatcctgagatctctggcctacagcaacgccaacaaggaatgtcagaagctgctgcaagccagaggccacaccaacagccccctgggcgacatgctgcgcgcctgccagacctggacccctaaggacaagaccaaggtgctggtggtgcagcctaagaagcctccccctaatcagccctgcttccggtgcggcaaggccggacactggagccgggactgcacccagcctcggcctccaccgggaccttgtcctctgtgccaagaccccacacactggaagagagattgcccccgcctaaagcccactatcccagaaccagagccagaggaagatgccctcctattagacctccccgctgacattccacacccaaaaaactccatagggggggagggtttaacctctcctcctaccctgcagcaggtgttcctgaatcaagatcctgccagcatcctgggtgcccctcaagtgctgccagtgatgcacggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1114 - DNA, 4407 bp, synthetic construct
  misc_feature 1..4407: note = pXDP134 sequence
  source 1..4407: mol_type = other DNA
atgggccaaatcttttcccgtagcgctagccctattccgcgaccgccccgggggctggccgctcatcactggcttaacttcctccaggcggcatatcgcctagaacccggtccctccaattgcgctttccacctgttaagaagatatcatgaaacagtttccggaataccggctcggatctgtcccattaactactccctcctagccagcctactcccaaaaggataccccggccgggtgaatgaaattttacacatactcatccaaacccaagcccagatcccgtcccgtcccgcgccaccgccgccgtcatcccccacccacgaccccccggattctgatccacaaatcccccctccctatgttgagcctacggccccccaagtccttccagtcatgcatccacatggtgctcctcctaaccatcgcccatggcaaatgaaagacctacaggccattaagcaagaagtctcccaagcagcccctgggagcccccagtttatgcagaccatccggcttgcggtgcagcagtttgaccccactgccaaagacctccaagacctcctgcagtacctttgctcctccctcgtggcttccctccatcaccagcagctagatagccttatatcagaggccgaaacccgaggtattacaggttataacccattagccggtcccctccgtgtccaagccaacaatccacaacaacaaggattaaggcgagaataccagcaactctggctcgccgccttcgccgccctgccggggagtgccaaagacccttcctgggcctctatcctccaaggcctggaggagccttaccacgccttcgtagaacgcctcaacatagctcttgacaatgggctgccagaaggcacgcccaaagaccccatcttacgttccttagcctactccaatgcaaacaaagaatgccaaaaattactacaggcccgaggacacactaatagccctctaggagatatgttgcgggcttgtcagacctggacccccaaagacaaaaccaaagtgttagttgtccagcctaaaaaaccccccccaaatcagccgtgcttccggtgcgggaaagcaggccactggagtcgggactgcactcagcctcgtcccccccccgggccatgccccctatgtcaagacccaactcactggaagcgagactgcccccgcctaaagcccactatcccagaaccagagccagaggaagatgccctcctattagacctccccgctgacattccacacccaaaaaactccatagggggggaggttttaacctccccccccacattacagcaagtctttcttaaccaagacccagcatctattctggcccctcaagtgctgccagtgatgcacggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1115 - DNA, 4677 bp, synthetic construct
  misc_feature 1..4677: note = pXDP135 sequence
  source 1..4677: mol_type = other DNA
atgggccagaccgtgaccacacccctgtccctgacactgggccactggaaggacgtggagcggatcgcccacaatcagtctgtggatgtgaagaagcggagatgggtgaccttctgcagcgccgagtggcccaccttcaacgtgggctggccaagggacggcaccttcaaccgcgatctgatcacacaggtgaagatcaaggtgtttagcccaggacctcacggacacccagaccaggtgccttatatcgtgacctgggaggccctggccttcgatccacctccatgggtgaagccatttgtgcacccaaagccacctccaccactgcctccatccgccccttctctgccactggagccacctcggtccaccccaccaagaagctccctgtatcctgccctgacaccatctctgggcgccaagccaaagccacaggtgctgtctgacagcggaggacctctgatcgacctgctgaccgaggatcctccaccctacagagatccaaggcctccaccatccgacagggatggaaacggaggagaggcaacaccagcaggagaggcccctgacccatcccccatggcctctagactgaggggcaggcgcgagcctccagtggcagatagcaccacatcccaggcattcccactgagggcaggaggaaatggccagctgcagtattggcccttttctagctccgacctgtacaactggaagaacaataacccatccttctctgaggatcccggcaagctgaccgccctgatcgagagcgtgctgatcacccaccagcccacatgggacgattgtcagcagctgctgggcaccctgctgacaggcgaggagaagcagcgggtgctgctggaggcaaggaaggccgtgagaggcgacgatggcagacccacccagctgcctaatgaggtggacgcagcatttccactggagaggccagactgggattataccacacaggccggcaggaaccacctggtgcactacaggcagctgctgctggccggactgcagaatgcaggcaggtcccctaccaacctggccaaggtgaagggcatcacacagggccctaatgagagcccatccgcctttctggagcgcctgaaggaggcctaccggagatataccccctacgaccctgaggatccaggccaggagacaaacgtgtctatgagcttcatctggcagtctgccccagacatcggaaggaagctggagcgcctggaggacctgaagaataagaccctgggcgatctggtgcgggaggcagagaagatcttcaacaagagagagacacctgaggagagggaggagcggatcaggagggagaccgaggagaaggaggagcggagaaggacagaggacgagcagaaggagaaggagcgggatcgccggagacacagagagatgagcaagctgctggccaccgtggtgtccggacagaagcaggacaggcagggaggagagaggcgccggtctcagctggaccgcgatcagtgcgcctactgtaaggagaagggccactgggccaaggattgccccaagaagcctagaggcccaaggggccctaggccacagaccagcctgctgacactggacgatggtgccagctccctgtatcctgccctgacaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1116 - DNA, 5274 bp, synthetic construct
  misc_feature 1..5274: note = pXDP136 sequence
  source 1..5274: mol_type = other DNA
atgggcgtgtccggctcaaagggccagaagctgtttgtgtccgtgctgcagcgtctgctgtccgaacggggcctacacgtgaaagagagcagcgccatcgagttctaccagtttctgatcaaggtgtcaccctggttccccgaggaaggcggcctgaatctgcaggattggaagagagtgggcagagaaatgaagaagtacgccgctgagcacggcaccgacagcatccccaagcaggcttatcctatctggctgcaactgagagagatcctgacagagcaatctgacctggtgctgctgagcgccgaggccaagtccgtgacagaggaagaactggaagaaggcctgacaggactgctgagcgccagcagccaggagaagacctacggcacaagaggcaccgcctatgccgaaatcgacaccgaggtggataagctgagcgagcacatctacgacgagccctacgaggagaaggaaaaggccgacaagaacgaggagaaggaccacgtgcggaaggtcaagaagatcgtgcaaagaaaggaaaatagcgagcataagagaaaggagaaagatcagaaggccttcctggcaaccgactggaacaacgacgacctgagccctgaggactgggacgacctggaagagcaggccgcccactaccacgatgacgacgaactgatcctgcctgtgaagagaaaggtggacaagaagaagccgctcgccctgaggcggaaacctctgcccccggttggcttcgccggagccatggccgaggctagagagaagggcgatctgaccttcacatttcccgtggttttcatgggagaatccgacgacgatgatacccctgtgtgggaacctctgcccctgaagacactgaaggaactgcagtctgccgtgcggaccatgggccctagcgccccttacaccctccaggtggtggacatggttgcctctcagtggctgacacctagcgattggcaccaaaccgccagagccaccctgtctcctggggactacgtgctgtggcggaccgagtacgaggagaagagcaaggaaaccgtgcagaagaccgctggcaagcggaaaggcaaggtgagcctggatatgctgctgggcacaggtcagttcctgagcccttcttctcagatcaagctttctaaagatgtgctgaaggatgtgaccaccaacgccgtcctggcctggagagccatccctcctccaggcgtcaaaaagacagtgctggccggactcaagcagggaaatgaggaaagctacgagacattcatcagcagactggaagaggccgtgtacagaatgatgcctagaggagaaggcagcgacatcctgatcaagcagctggcttgggagaacgctaattctctgtgccaggacctgatccggcctatgcggaagaccggcaccatgcaggactacatcagagcctgtctggatgcctcccctgccgtggtgcagggcatggcctacgccgccgcaatgagaggacaaaagtacagcaccttcgtgaaacagacatacggcggcggaaaaggcggacagggctctgaaggccctgtgtgcttcagctgcggcaaaacaggtcacattaagcgggattgcaaggaagagaaaggaagcaagcgcgctcctcctggactgtgtcctagatgcaagaaaggctaccactggaagagcgagtgcaagagcaagttcgacaaggacggcaaccctctgccaccactggaaactaacgccgaaaacagcaaaaaccccacacagaaaggcgacaaaggaaaggacagcggactgaaccccgaagcccctcctttcaccatccacgacctgccacgaggcaccccaggcagtgccggcttggacctgagcagccagaaagacctgatcctgtctctggaagacggcgtgtccctggtgccaaccctggtgaagggcaccctgcccgagggcaccacgggactgatcatcggcagatccagcaactacaagaaaggcctggaggtgctgcccggcgtgatcgactccgacttccagggcgaaattaaggtcatggtaaaggccgctaagaacgccgtgatcatccacaagggcgagcggatcgcgcagctgctgctgctgccttatctgaaactgcctaaccctatcatcaaggaggaaagaggcagcgagggatttggcagcacctcccacgtgcacggtgccgacctggtgctgctgagcgccgagggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1117 - DNA, 5034 bp, synthetic construct
  misc_feature 1..5034: note = pXDP137 sequence
  source 1..5034: mol_type = other DNA
atgggccaggagctgtcccagcacgagcggtacgtggagcagctgaagcaagcccttaaaacaagaggcgtgaaggtgaaatacgccgacctgctgaagttcttcgattttgtgaaggatacctgcccttggttccctcaggagggcaccatcgacatcaagagatggcgcagagtgggcgactgcttccaagattactacaacaccttcggacctgagaaagtgcctgtgaccgccttcagctactggaacctgatcaaggaactgatcgacaaaaaggaagtgaacccacaggtgatggctgctgtcgcccagaccgaggaaatcctgaagagcaacagccagacagacctgaccaagaccagccagaaccctgacctggatctgatcagcctggacagcgatgatgagggcgccaagtccagcagcctgcaggacaagggcctgagcagcaccaaaaagcctaagcggttccccgtcctgctgaccgcccagacaagcaaggacccagaggatcctaacccaagcgaggtggactgggacggcctggaggacgaggccgctaagtaccacaaccctgactggccccccttcctgacaagacctccaccttacaacaaggctacccctagcgcccctaccgtgatggccgtggtgaaccctaaagaggaactgaaagaaaagatcgcccagctggaagagcagatcaaactggaagagctgcaccaggccctgatttctaagctgcaaaagctgaaaaccggcaacgagacagtcactcaccctgatacagccggaggcctgagcagaacaccacattggcccggccagcacatccctaagggcaagtgctgcgccagccgggaaaaggaagagcagatccccaaggatatcttccctgtgaccgaaaccgttgacggacagggccaggcatggagacaccacaatggcttcgacttcgccgtgatcaaggaactgaagacagccgcctctcaatacggcgccaccgcaccttacaccctggctatcgtggaatccgtcgccgacaactggctgaccccaaccgactggaataccctggtgcgggccgtgctgtctggcggcgaccacctgctctggaagtctgagttcttcgagaactgtagggacaccgctaagcggaaccagcaggccggcaatggatgggattttgacatgctgaccggcagcggcaactacagctctacagacgcccaaatgcagtacgaccctggcctgttcgcccagattcaggccgctgccacaaaggcctggcggaagctgcccgtgaagggggatcccggcgccagcctgaccggcgtgaagcagggccccgatgagcctttcgccgacttcgtgcatagactgatcaccacagccggcagaatcttcggctccgccgaagccggcgtggactacgtgaagcagctggcttacgagaacgccaaccctgcctgccaggccgcaatcagaccctatagaaagaagacagatctgaccggctacatccggctgtgcagcgacatcggcccttcctatcagcagggactggctatggccgctgcctttagcggccagaccgtgaaggacttcctgaacaacaagaacaaggaaaagggcggatgttgttttaagtgcggcaagaaaggacactttgccaaaaactgccacgagcacgcccacaacaacgccgagcccaaggtgcccggcctgtgtcctcggtgcaagagaggcaagcactgggccaatgagtgcaagtccaagacagataaccagggaaatccaatccccccccatcagggaaatggtgcttctcctagacctagaaacaagctgatgggccaaagcgccctgttccagcctaccaagacaacccacttcaaggcctaccagagccaccccagaaagtgcagaatcggccctctgttccacctgccccacagcatcaacgccggtgccccacaggtgatggctgctgtcgccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1118 - DNA, 5034 bp, synthetic construct
  misc_feature 1..5034: note = pXDP138 sequence
  source 1..5034: mol_type = other DNA
atggggcaagaattaagccagcatgaacgttatgtagaacaattgaagcaggctttaaagacacggggagtaaaggttaaatatgctgatcttttgaaattttttgattttgtgaaggatacttgtccttggtttccgcaagagggaaccatagatattaaacggtggcgtagagtaggcgactgtttccaagactattacaatacttttggcccggagaaagtcccagtaactgcattctcttactggaacttaattaaagaattgatagataagaaagaagttaacccacaagtaatggctgccgtagcccaaactgaagaaattttaaaaagtaattctcaaacagacctcacaaagacctctcaaaacccagacttggaccttatttcccttgatagcgacgatgaaggagctaaaagttcctctctacaagataaaggtttatcaagtactaaaaaaccaaaaagattcccagttctgttaacagcacaaactagtaaagaccctgaagaccccaacccctcagaggtagactgggacggcttggaagatgaggcagcgaaatatcataatcccgattggcctcccttcctaacccgtccacctccttacaataaagctactccttccgcacccactgtaatggcggttgttaatccaaaagaggagctcaaagaaaaaattgctcaattagaggaacagattaaattagaagagttacaccaggcactaatttccaaattacaaaaactaaaaacagggaatgaaactgtaactcacccagacacagcaggaggcctttctcgcacgcctcactggccagggcaacatatccctaaaggaaaatgttgcgccagtcgagaaaaggaagaacaaatcccaaaagatattttcccagtgactgaaaccgttgatgggcaaggtcaagcctggagacaccataatggttttgattttgccgtcataaaagaattaaaaacagctgcttcccaatatggggctactgccccatacacattagccatagtggaatctgtagcggacaattggcttacccctacagattggaatacgcttgttagggcagtcctctcaggaggagatcacttactgtggaaatctgagttttttgaaaattgcagagatacggctaaaagaaaccaacaagccggtaatggctgggattttgacatgttaacaggttcgggtaattattccagcaccgatgcacaaatgcagtatgatccaggattgtttgctcaaattcaagcggctgctacaaaagcctggagaaaacttcccgttaagggagacccaggagcctcccttacaggagtcaaacaaggacccgatgagccatttgcagatttcgtacacagacttataacaactgctgggagaatctttggaagtgctgaggccggtgtagactatgtaaaacaactagcatatgaaaatgctaatccagcttgtcaggcagccattcgcccctatagaaagaagacagatttaactggctatatccgtctttgctcggatattgggccctcttatcagcaaggcctggccatggccgccgcctttagcgggcagactgtaaaagattttcttaacaacaaaaataaagagaaaggagggtgttgctttaaatgcggtaaaaaaggacactttgcaaaaaattgtcatgaacatgcacataacaatgctgaaccaaaagttcccggactctgccctagatgtaaaagagggaaacattgggccaatgaatgcaaatccaaaactgataatcaaggaaacccaataccaccccatcagggaaacggggccagccccaggccccgaaacaagcttatggggcagtcagctttgttccagccaacaaaaacaacccatttcaaagcttaccagagccaccccaggaagtgcaggattggacctctgttccacctcccacacagtattaacgccggtgccccacaggtgatggctgctgtcgccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1119 - DNA, 4794 bp, synthetic construct
  misc_feature 1..4794: note = pXDP139 sequence
  source 1..4794: mol_type = other DNA
atggaggccgtgatcaaggtgatcagcagcgcatgcaagacctactgcggcaagaccagcccatctaagaaagagatcggcgccatgctgagcctgctccaaaaggaaggcctgctgatgagcccttccgacctgtacagccccggaagctgggacccaatcaccgctgccctgacccagcgggccatggtgctgggaaagagcggcgagctgaagacctggggcctggtgctgggagccctgaaggccgccagagaggaacaagtgacaagcgaacaggccaagttctggctgggactgggcggaggaagagtcagccctcctggcccagagtgcatcgagaagcccgctacagagagaagaatcgataagggcgaagaggtgggcgagacaacagtgcagagagacgccaagatggctcctgaggaaaccgccacacctaagaccgtgggcacatcttgttaccactgcggcaccgccattggatgtaactgcgctacagccagcgcccccccccctccctacgtgggcagcggactttatcctagcctggccggcgtgggagagcagcagggccaaggcggagatacacccagaggcgccgagcagcctagagccgaacccggccacgccggactggcccctggcccagccctgaccgactgggcccgcatccgggaagaactggcttctaccggccccccggtggtcgccatgcctgtggttatcaagacagagggccctgcttggacccctctggaaccaaagctgattacaagactcgccgacaccgtgcggaccaagggcctgcggagccctatcaccatggccgagatggaagctctgatgagcagcccactgctgccccacgacgtgaccaacctgatgagagtgatcctgggccccgccccttacgccctgtggatggacgcctggggggtgcagctgcagaccgtgattgccgccgccaccagagatcctagacaccctgctaacggccaaggcagaggcgaaagaaccaaccttgacagactgaaaggcctggccgatggaatggtcggcaacagcgaaggccaggccgccctgctgagacctggcgagctggtggctatcacagccagcgccctgcaggccttcagagaagtggcccgactggctgagcccacggacccttgggccgacatcatgcagggcccttctgagagcttcgtggacttcgccaatagactgatcaaggccgtcgagggcagcgatcttcctcctagcgcgagagcccctgttatcatcgactgcttccggcagaaaagccagcccgacatccaacagctgatcagagccgccccttccaccctgaccacaccaggcgagatcatcaagtacgtgctggatagacagaagaccgcccctctgaccgatcagggcatcgccgctgccatgtcctctgccatccagcctctggtgatggccgtggtgaacagagagagagacggccagacaggctccggcggccgggccagagagctgtgctacacctgtggctctccaggccactaccaggctcagtgtcctaaaaagcggaagtctggcaattctagagagcggtgccagctgtgcaacggcatgggccataatgccaaacagtgtcggaaacgggacggaaaccagggccagagaccaggcagaggcctgtcttctggcccctggcccggccctgagcctcctgctgtgtccggtgccacatcttgttaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1120 - DNA, 4584 bp, synthetic construct
  misc_feature 1..4584: note = pXDP140 sequence
  source 1..4584: mol_type = other DNA
atgggcgccaggaacagcgtgctgtccggcaaggaggccgatgagctggagaaggtgcggctgagacccaatggcaagaagaagtacatgctgaagcacgtggtgtgggcagcaaacgagctggaccgcttcggcctggccgagtctctgctggataataaggagggctgccagaagatcctgagcgtgctggcccctctggtgccaaccggctctgagaacctgaagagcctgtataatacagtgtgcgtgatctggtgtatccacgccgaggagaaggtgaagcacaccgaggaggccaagcagatcgtgcagaggcacctggtggtggagaccggcacagcagataggatgccagccaccagccgcccaacagcaccaccttccggaaggggcggcaactaccccgtgcagcaagtgggcggcaattatgtgcacctgcccctgagccctagaaccctgaacgcctgggtgaagctggtggaggagaagaagttcggagcagaggtggtgccaggatttcaggccctgtccgagggctgcacaccctacgacatcaaccagatgctgaattgcgtgggagagcaccaggcagcaatgcagatcatccgggagatcatcaacgaggaggcagcagactgggatctgcagcaccctcagccaggaccactgcctgcaggacagctgcgggagcctagaggctctgacatcgccggcaccacaagcaccgtggatgagcagatccagtggatgtacaggcagcagaacccaatccccgtgggcaatatctatcggagatggatccagctgggcctgcagaagtgcgtgcggatgtataacccaaccaatatcctggacgtgaagcagggcccaaaggagcccttccagagctacgtggacagattctacaagtccctgagagccgagcagacagatcccgccgtgaagaactggatgacccagacactgctgatccagaacgccaatcccgattgcaagctggtgctgaagggcctgggcatgaatcctaccctggaggagatgctgacagcatgtcagggagtgggaggacctggacagaaggcaaggctgatggcagaggccctgaaggaggccctgaggcctgaccagctgccatttgccgccgtgcagcagaagggccagaggaagaccatcaagtgctggaactgtggcaaggagggacactctgccaagcagtgcagggcaccaaggcgccagggatgctggaagtgtggcaagacaggccacgtgatggccaagtgtcctgagaggcaggcaggcttcctgggactgggaccatggggcaagaagccaagaaattttcctatggcccagatgcctcagggactgatcccaaccgcaccaccagaggacccagcagtggatctgctgaagaactacatgaagatgggcaggaagcagcgcgagaatagggagcgcccttataaggaggtgacagaggacctgctgcacctgaactctctctttggagaagaccagggtgccggcggcaactaccccgtgcagcaaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1121 - DNA, 4584 bp, synthetic construct
  misc_feature 1..4584: note = pXDP141 sequence
  source 1..4584: mol_type = other DNA
atgggcgcgagaaactccgtcttgtcagggaaggaagcagatgaattagaaaaagttaggttacggcccaacggaaagaaaaagtatatgttgaagcatgtagtatgggcagcaaatgaattggacagatttggattagcagaaagcctgttggataacaaagaaggttgtcaaaaaattctttcagttttagctccattagttccgacaggttcagaaaacttaaagagcctttataatactgtctgcgtcatttggtgcattcacgcagaagagaaagtgaaacatactgaggaagcaaaacaaatagtgcagagacatctagtggtggaaacaggaacagcagacagaatgccagcaacaagcagaccaacagcaccacctagtggcagaggaggaaattacccagtgcagcaagtaggtggcaattatgtccacctacccttaagtccaagaacattaaatgcttgggtaaaattagtagaagagaaaaaatttggggcagaggtagtgccaggatttcaagcgctatcagaaggctgcactccctatgatattaatcaaatgctaaattgtgtaggagaacatcaggcagccatgcaaattattagagagattataaatgaagaagctgccgattgggatttacaacacccgcaaccaggtccactaccagcagggcaacttagagagccaagaggatcagacattgcaggaactactagtacagtagatgaacaaatccaatggatgtacaggcaacaaaaccccataccagtaggcaacatttatagaaggtggatccaattagggctgcagaaatgtgtaagaatgtataacccaacaaacattttagatgtgaaacaaggaccaaaagagccatttcaaagctacgtagatagattctacaaaagtctaagagcagagcaaacagatcccgcagtaaagaattggatgacccaaacactgctgattcaaaatgctaacccagattgtaaactagtgctcaagggtctgggcatgaatcccactttagaagaaatgctgacagcctgtcagggagtaggagggccaggacaaaaagctaggttaatggcagaagcattgaaagaggcactgaggccagatcaactcccatttgcagcagtccaacagaaaggacaaaggaagacaatcaagtgttggaattgtggaaaggagggacactctgcaaaacaatgcagggcccctagaagacagggctgctggaagtgtggaaaaacgggtcatgttatggccaaatgccctgaaagacaggcgggttttttagggcttggcccatggggaaagaagccccgcaatttccccatggcccagatgcctcaggggctgataccaactgctcccccagaggatccagctgtggatctactgaagaattacatgaagatgggcagaaagcagagggagaacagagagagaccttacaaggaggtgacagaggatttgctgcacctcaattctctctttggagaagaccagggtgccggcggcaactaccccgtgcagcaaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1122 - DNA, 4389 bp, synthetic construct
  misc_feature 1..4389: note = pXDP142 sequence
  source 1..4389: mol_type = other DNA
atggccaagcagggctccaaggagaagaagggctaccccgagctgaaggaagtgatcaaggcaacctgcaagatcagggtgggacctggcaaggagaccctgacagagggcaactgtctgtgggccctgaagacaatcgacttcatctttgaggatctgaagaccgagccatggaccatcacaaagatgtatacagtgtgggatcggctgaagggactgaccccagaggagacatccaagagagagttcgcctctctgcaggccaccctggcctgcatcatgtgctcccagatgggcatgaagcctgagacagtgcaggccgccaagggcatcatctctatgaaggagggcctgcacgagaataaggaggccaagggcgagaaggtggagcagctgtaccctaacctggagaagcacagggaggtgtatccaatcgtgaatctgcaggcaggaggccgcagctggaaggcagtggagtccgtggtgttccagcagctgcagaccgtggccatgcagcacggcctggtgtctgaggactttgagcggcagctggcctactatgccaccacatggacaagcaaggatatcctggaggtgctggccatgatgccaggcaacagagcccagaaggagctgatccagggcaagctgaatgaggaggcagagcggtgggtgagacagaacccacctggacccaatgtgctgaccgtggaccagatcatgggcgtgggccagacaaaccagcaggccagccaggccaatatggatcaggccaggcagatctgcctgcagtgggtcatcaccgccctgaggagcgtgcgccacatgtcccacaggcctggaaacccaatgctggtgaagcagaagaatacagagtcctacgaggacttcatcgccaggctgctggaggcaatcgacgcagagcccgtgacagatcctatcaagacctacctgaaggtgaccctgtcttatacaaacgccagcaccgactgccagaagcagatggataggaccctgggaacacgcgtgcagcaggcaaccgtggaggagaagatgcaggcctgtcgggatgtgggctctgagggctttaagatgcagctgctggcccaggccctgagacctcagggcaaggcaggacagaagggagtgaaccagaagtgctacaattgtggcaagccaggacacctggcaaggcagtgcagacagggaatcatctgccaccactgtggcaagaggggccacatgcagaaggactgtcgccagaagaagcagcagggcaacaataggagaggaccaagggtggtgccatctgccccaccaatgctgggtgccagggaggtgtatccaatcgtgaatggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1123 - DNA, 4809 bp, synthetic construct
  misc_feature 1..4809: note = pXDP143 sequence
  source 1..4809: mol_type = other DNA
atgggcaatagctcctctaccccccctccaagcgccctgaagaactccgatctgttcaagaccatgctgaggacacagtacagcggctccgtgaagacacggagaatcaaccaggatatcaagaagcagtatccactgtggccagaccagggaacctgcgcaacaaagcactgggagcaggccgtgctgatccccctggactctgtgagcgaggagaccgccaaggtgctgaatttcctgcgggtgaagatccaggccagaaagggagagaccgcaaggcagatgaccgcacacacaatcaagaagctgatcgtgggcacaatcgataagaacaagcagcagaccgagatcctgcagaagacagacgagagcgatgaggagatggacaccacaaataccatgctgtttatcgcccgcaacaagagggagaggatcgcacagcagcagcaggcagatctggcagcacagcagcaggtgctgctgctgcagagggagcagcagagggagcagagagagaaggatatcaagaagcgggacgagaagaagaagaagctgctgcccgacaccacacagaaggtggagcagaccgatatcggagaggccagctcctctgacgcctccgcccagaagccaatctctaccgacaacaatcccgatctgaaggtggacggcgtgctgacaagaagccagcacaccacagtgccttccaacatcaccatcaagaaggatggcacatccgtgcagtaccagcaccccatcaggaactatcctaccggcgagggcaatctgacagcccaggtgcggaacccttttagaccactggagctgcagcagctgaggaaggactgccccgccctgcctgagggcatcccacagctggccgagtggctgacccagacaatggccatctacaattgtgacgaggccgatgtggagcagctggccagagtgatcttcccaacccctgtgaggcagatcgcaggcgtgatcaacggacacgcagcagcaaataccgcagccaagatccagaactacgtgacagcatgcaggcagcactatccagccgtgtgcgattggggcaccatccaggcctttacatacaagccccctcagaccgcccacgagtatgtgaagcacgccgagatcatcttcaagaacaatagcggactggagtggcagcacgcaaccgtgccttttatcaatatggtggtgcagggcctgccacccaaggtgacacggtccctgatgtctggcaacccagattggagcaccaagacaatcccacagatcatccccctgatgcagcactacctgaatctgcagtccagacaggacgccaagatcaagcagacccctctggtgctgcagctggccatgccagcccagacaatgaacggcaataagggctacgtgggctcctatcctaccaacgagccatactattctttccagcagcagcagaggccagcacccagagcccctccaggcaacgtgccttccaatacctgcttcttttgtaagcagccaggacactggaaggcagactgccctaataagacaaggaacctgcgcaatatgggcaacatgggaaggggaggaagaatgggaggaccaccttaccggagccagccttatccagcctttatccagccaccccagaatcaccagaaccagtataatggcaggatggatcgctctcagctgcaggccagcgcccaggagtggctgccaggaacctaccctgcaggtgccgcaaggcagatgaccgcacacacaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1124 - DNA, 4698 bp, synthetic construct
  misc_feature 1..4698: note = pXDP78 sequence
  source 1..4698: mol_type = other DNA
atggccctgaatgatttcgaccctatcgccctccagggctacctgccggcccctagagtgctgcaacacaacgacatcatcatctgcagagctacttctggcccctggggcatcggcgacagatacaacctgatcaggatccacctgcaagaccctgccggacagccccttccaatcccccagtgggagcctatccctaaccggaccgccaacccccggacacagccctaccctgtggtgtctgccccaatggctaccctggaaaacatcctgaacaactttcacatcccccacggcgtgtccagatacggccccctggaaggcggagattaccagcctggcgaacagtacagccaaggcttctgccctgtgacccaggccgagattgccctgctgaacggccagcacctggaagaagagatcacaatcctgagagagatcacccacagactgatgcagggcgtgcggcctcctgccgtgcctcagggccctgctcctcctcctcctccagctcagcctcctgctcccctgcctgctccaccaattgggcctccacctcccgctgcccctgcccccgccccaggccccatgcctgtgccccagcatctgcctattacacatatcagagccgtgatcggcgaaacccccgccaacatccgcgaggtgccactgtggctggctagagccgttcccgccctgcagggagtgtaccccgtccaggacgccgtgatgagaagccgcaccgtgaacgccctgaccgtgcggcaccctggactggccctggaacctctggagtgcggcagctggcaagagtgtctggccgccctgtggcagagaaccttcggcgccaccgccctgcacgccctgggcgataccctgggtcagatcgcaaacagcgacggcatcgtgatggctatcgagctgggcctgctcttttccgatgataactgggacctggtgtggggaatctgtagaagattcctgcccggccaggccgtctgcgtggccgtgcaggccagactggatcccctgcccgacaacgctacaagaatcgtgatgatcagccacatcatccgggacgtgtacgccatcctgggcctggaccctctgggcagacccatgcagcagacactgcctagacggaacaaccagcctcccagacagcagccacagagacggcagcagcctagaagaaccggcaaccaggaggaaagaggccagcggaaccggggccggcagaacgcccagacccctcggcaggagggcaacagactgcagaacagccagctgcctggccctcgcgactgccccaacaatagcaaccagcctcggtaccctctgcggccaaacccccagcagccccaaagatacggccaggagcagaatcgtggcaacaatcccaacccttacagacaacctacccctggcaatggaaatcaaaacagaaacttcagccgggggcctgccccagtcaatgagcagagcagaggcagaggaagatctagccagggtacaaataacaccggctcctctgctgtgcacagcgtgcggctgaccagcgccgcccctcctatacccccacaagatgccggcactccgcccacttcaagtggaaatcaagggcaatcatcttaaggtgcctctgctgtgcacagcgtgcggctgggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1125 - DNA, 4995 bp, synthetic construct
  misc_feature 1..4995: note = pXDP79 sequence
  source 1..4995: mol_type = other DNA
atgagccagccctccgcttctggcagcgccggcgccggaggcgcccctcagcaacctcctcctccacctccccagcccggacctgccgcccccgtgcctagagcccagatcggttatggagatctggacgtgcttctgctgcaacaggagtaccacctcatcgatcctaatctgcaagtgcaacacctggacaccctgctggtgagaatcacaggcggaaactggggccctggcgatagattcgccagaatcgaggtgctgctccgcgacacactgggccctctgcaacagcctagatacagatacgccgccatgcagcaggccgacctgagaaacgacatcatcctgcacctgaactaccaggatgccatcatcatcttcgacatgatcatccccagcgagggcgtgcaccggcacggccctatgtttgacggcctgtggatccacggcgacgactacagcatgaacttccagcctatcacagcccacgagctgtacctgctgcctcagcaggtgctgaccgaggaagtggaactgctcaccgaggtgtgcaacagaatggccgattggatccggcggcacaggtgtggcggaggaagcggctcctctcagccacctcctcccccacctccagccgtgccagtgctgcctagtgcccctccagccagcagcctgcccctgcccccacagggctggggcatctctcctcccgtggctaccagcacccctggcgctgccggacattctagcagcgccggtcctaacatcagcctgggcggcacctacgtgccccctcctgtggctcctccagcccctgtgatcggcggccctggcggacccggacagctgcctgctatggtgcaggtgctgcccgctcaacctgtcgtgatccccattaacgtgatcagatctgtgtgcggcgatacacctagcaaccctcaagacatccctctgtggatgggcagaatcatccccgccattgagggcgtctttcctattgacaaccccaatctgagaatgagagtggtgaacgccctgctggctctgcatcctggcctggctatcaccgaactgaatgcccagacatggggccaggttctggctgtgctgcacatgcgggccctgggacacaccgccctgcaccagctgcctgccctgctggaaacaatcgtgaagaccgacggcatcctgccagcttataacatgggcatggaagttacacagcaggatttcagctacgtgtggggcatcctgcggacactgttgcccggccaagccttcgtgctgagcatgcagaacgagctggaccggctgcctgccgcccagagacctggaatgttccccggcctgctgcagagaaccctggatatcctgggcctgaacagcagaggacagaacatccagaaaaccaacacccagcagcaggccccaaagcggggccagaagcctaagcccagactgcccccagtgcacagacggcctgcacccttcacccctcctgccacccccagccctcggcagcaggccagcgccagccccagcagccagggcgacaacagaagccctcagcctcagggcagaggcacatacggcccgagccggggaggcggctctggccctagatacaacttccgtcccagagtgcagcctcccgacagatacggcttcggcagaggccagggaggcagaagcagcatcggcgcccaggacaatcagcagcccggacaaggcggacagcggacccagcagaccaaccagaaccgcaaccagggcaacgccaccggcggtagaacccagcctcagaatagaacagtgaacaccgtgcgggtgacccagaccaatcctcaaggcggctcctccgtgtccaacccagctgtgacaacttctcagaatacaggaacaggaagtgcaactcagagctcatcatcttaaggtgccagaacagtgaacaccgtgcgggtgggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1126 - DNA, 5010 bp, synthetic construct
  misc_feature 1..5010: note = pXDP80 sequence
  source 1..5010: mol_type = other DNA
atggcctctggcagcaacgtggaggaatacgagctggatgtggaagccctggtggtcatcctgcgggacagaaacatcggaagaaatcccctgcacggcgaaatcatcggcctgagactgaccgagggctggtggggccagatcgagagatttcagatggtgcggctgatcctgcaggacgacgacaacgagcccctgcagagaccccgctacgaggtgatccccagagccgtgaacccccacaccatgttcatgatcagcggccccctggctgaactgcagctggccttccaggacctggacctgcccgagggccctctgcggtttggcccgctggctaacggccactacgtgcagggggatccttacagcagcagctaccggcccgtgaccatggccgaaacagcccagatgaccagagatgagctggaagatatcctgaacacccaaagcgagatcgagatccagatgatcaacctgctggaactttatgaggtggaaaccagagccctgagaagacagctggccgagagaagcagcatcggccagggaggagtgagccccggcgctccaaggccgagacctccagttagcagcttcagcggcctgcctagcctgccttctatccccggcatccaccccagagccccttcccctcctcgcgctacaagcacccctggtaacatcccctggtccctgggagatgacagcccacctagctcgtcttttcctggccctagtcagcctagagtgtctttccaccctggcaatcctttcgtggaggacgagggacatagacctagatcccagagccgggaaagacggagaaacaatcctcctgcccctatccctagcgcccctccaatgatccaatacgtgcccgtgcctcctccacctcctgtcggaaccgtgatacctatccaacacatccggtccgtgaccggcgagcctccaaagaacccccgagaaatccccatctggctgggccggaatgcccctgctatcgacggcgttttccccgtgacgaccccagacctgcggtgcagaatcatcaacgccattctgggaggcaacctgggcctgagcctgacacctgccgactgtgtgacctgggactctgccgtgggcaccctgttcgtgcggacacacggacagttccctatgcaccagctgggcacagtgatccagggcatcgtgaaccaggagggcgtggctaccgcttatacactgggcatgatgctgagcggccagaattaccccctcgtgagcggcatcatcagaggctacctgcccggccaggccgtggtgaccgcccttcagcagcgcctggaccaggaggtggatgaccaggccagggctgaaaccttcatccagcacctgaacgctgtgtacgagatcctgggcctcaacgccagaggacaatctatcagagccagcgtgacaccgcaacctcggccaagccggggccgcggcagaggccagtctacacctagaccttcccagggccctgtgagttcaggacggggcagacagcggcctgccagcggccagtacgacagaggcagcaacaaccagaaccaagaccagggtaacaccagccagggcggctacaacctgagaccaagaacctaccagcctcagagatacggcggcggaagaggtcggagatggaacgagaacaccaacagccaggagagcagacccagcgatcagggctcccagacaccccggcctaaccaagctggcagcggcgtcagaggcaaccagagccagacccctagacccgccgccggcagaggaggcagaggcaatcagaatagaaaccagcggtctagcggagccggcgatagcagagccgtcaacacagtgacccagagtgccacgtcctccacagatgaatcctcttcagctgttgcaaccgcttccagcggagatcaaaggaactaaggtgccagagccgtcaacacagtgacccagggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1127 - DNA, 4663 bp, synthetic construct
  misc_feature 1..4663: note = pXDP81 sequence
  source 1..4663: mol_type = other DNA
atggcccagaacgagacatttgatcctgtggccctgcagggctactaccctgctggcggcatcctggccgacaatgacattatcaacatcagattcaccagcggacagtggggcatcggcgatagatggctgcaggtgcggctgagactggtggaccctaatactggacagcctctggctcagcctgagtacgaggacacaggcctgcctgccgaaaacaggggtatcgtggtggccgtgtcccacaacgccgccagaaatatcttcaacaacgtgcagccagctggtggccccaacagacacggccctctgcacgacggccaatttcaagtgggcgacgatcccagcgagcacttcgtgcctattgaggaaaacctgatcccccaggagatcgtgaacctgggagcagctagaagagaagtgcggctgctgagagaaatgtgcgtgcggctgctgcacgtgagaagacagatgatgggcatgggcatgcctggcgctatccagcctcaaccgccagtgggccccctgcccgcccctgcccagccccctatccctggcccacctgtgcctccccccgtgcctccccccgcccctccagcccctgtcaacccccctgtccctccagtgcagcctatccaccacctgcctattacccacatccgggccgtgatcggcgagacacctgcccagatcagagatgtgcccctgtggctggcccagtccatccctgccctgaccggcgtttatcctgccatggacgccggaacactgacaagactggtgaacgcgatcaccgccagacaccccggactcgctcttggcatgaacgaggccggctcctggcacgaggccgttcatctgatctggcagaggaccttcggcgctacagccctccatgccttgtctgatgtgctgaagggcatcgcccagcggaacggcgtggtgatggccctggaaatgggcctgatgttcaccaacgacgactgggacctgacctggtctgtgatccggagatgtctgcctggacaagccagcgttgtgaccatccaggcccggctggatgccctgccaaacaaccaggccaggatcatccaggccggctttatcatcagagaggtgtacgaggtgctgggcctggacccactgggccggccactgaacttccctggaggcctgacccagcgagacaccgccgtgcccgtgaccagaggccggggccgcggaagaaccggccctagaagaggccctgtgctgcctgtcagcagcaaccagcgccggcaagaaaccgcaggcggcaaccagcctcagacccaaccccagcagcagaacacattcagcaatcagacaaatcagagaggaaaccagcggcagtggcaaaatagaggaaccgacagccagagacggtacttcttcagacccagaccaagccagcctcagcggtacggcagcaaccagggccctgacaaccctaatccctacagaggaagagatagcaccaatcaaagcggccaggagcggcagctgcctcagcagcaacagggctctagaaggggccctggcagaaacacaaacagcggcaacaacaccgtgcacaccgtgcggcaagtggaatcttctcagctacaacaaaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1128 - DNA, 4528 bp, synthetic construct
  misc_feature 1..4528: note = pXDP82 sequence
  source 1..4528: mol_type = other DNA
atggcccgggaactgaaccccctgcagctgcaacagctgtacatcaacaatggcctgcagcccaatcccggccacggagatatcatcgcagttagattcacaggcggcccttggggccccggagatagatgggccagagtgaccatccggctgcaggacaacaccggccagcctctgcaagtgcccggatacgacctggagcctggcatcatcaatctgcgggaagatatcctgatcgccggcccatacaacctcatcagaacagcttttctggacctggaacctgccagaggaccagagcggcacggcccgttcggcgacggcagactgcagcctggcgatggactgagcgagggatttcagcctatcaccgacgaggaaatccaggctgaagtgggcaccatcggcgccgcccgtaacgagatccggctgctgagagaagccttgcagagactccaggctggcggtgttggacggcctatccctggggccgtgctgcagcctcaacctgtgatcggacctgtgatccccatcaaccacctgagaagcgtgattggcaacacacctcctaaccccagagatgtggccctgtggttgggcagatctacagccgctatcgagggcgtgttccccatcgtggaccaggtgacccggatgagagtggtgaacgccctggtcgcctctcatcctggcctgaccctgacagagaacgaggccggcagctggaacgccgccatcagcgccctgtggcggaaggcccacggcgctgctgctcagcacgagctggccggagtgctgagcgacatcaacaagaaggaaggcatccagacagccttcaacctgggcatgcagttcaccgatggcaattggtccctggtgtggggaatcatcaggaccctgctgcccggccaggccctggtcacaaacgcccagagccagttcgacctgatgggcgacgacattcagcgggccgagaacttccccagagtgattaacaacctgtacaccatgctgggcctgaacatccacggccagagcatcagacctagagtgcagacccagcctctgcagaccagacctcggaaccctggcagaagccagcagggtcagctgaatcagcctcggcctcagaacagagccaaccagtcctacagaccccctcggcagcagcaacaacacagcgacgtgcctgagcagagggaccagagaggcccatctcaaccgcctagaggctctggcggaggctataacttcagaagaaatccccagcagcctcagcggtacggccaaggcccccccggcccaaacccttacagacggttcggcgacggcggcaatccccagcagcaaggcccgcctccaaatagaggccctgatcagggacctagaccaggcggcaaccctcgcggcggcggcagggggcagggcccccggaacggcggaggcagcgccgccgccgtgcacaccgtgaaagccagcgaaaacgaaactaaaaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1129 - DNA, 4977 bp, synthetic construct
  misc_feature 1..4977: note = pXDP83 sequence
  source 1..4977: mol_type = other DNA
atggccgctgtggaaggcgatctggacgtgcaagccctgaccgatctgttcaacaacctgggcatcaaccgggacccccggcaccgggaagtgatcgccctgcggatgacaggcggctggtggggccctgccaccagatacaacctgatcaccgtgctgctgcaggatgatcagggtcagcctcttcagcagccccggtggcgggccgagggccgggccgccaaccccgctgtgatgctgaccctggaagccccatggcaggacctgcggatggcctttgacaacgtcgacctggccgacgacacactgcggtttggccctctggctaacggcaattacatccccggcgacgagtacagcctggagttcatccctcccgccatgcaagagatcgcccaaatgcagagagatgagctggaaaacgtgctggacattgtgggccagatcacaatgcagatgagcgacctgatcggaatgcaggacgcccagatccggggcctggagggccaaatcagaggcctgagaggcaatctgcccgtggccggaacaccaccacctcctcctccaagcctggacctgcagcctgccgccgccagcagcccttacgtggcccctgcgtctagcgctcctgccgcacccgtggcctctgctgatctgggctggttcgccgggggaccttccccaggctctgtggaccctcggctggcccgggtcgcctacaaccccttcctgcccggacctagcgacggcagcggcgtggccccggtgcagccctccgcccctcctgccgccagccctctgctgcccctgccacctgctcagcctgtgcagccagtgatccagtacgtgcaccctcctcctatgaaccctgcccagcagattattcctatccagcacatcagagccgtgaccggcaacgcccccaccaaccctagagagatccctatgtggatcggcagaaacgccagcgccatcgagggcgtgttccccatgaccacccctgatctgaggtgtcgggtgatcaacgccctgctcggcggcaacctgggcctgaacctggaaccacagcactgcgtgacctgggccagcgcaatcgccaccctgtacgttagaacccacggcagctaccccatccaccagctggctgaagtgctgagaggcgtggctaatagcgagggagttgctgccgcttatcagctgggcatgatgctgacaaaccgggattacaacctgatctgggggatcatccgccctctgctgcccggccaggccgtcgtgaccgccatgcagcatagactggatcaggagatcaacgacgccgccagagtggcctctttcatcaatcacctgaacggcgtgtacgagctgctgggcttgaacgccagaggccagagcctgagaatccctgcctctggcggacagaccacggccggaaccagcgccggcagaggcacaagaggaagacgcagccagcaaggcacacctggcagacagagcagcggccagagccagcagcagggaagaagaagcagccagggccagagcagacagtcagactccagcgaccagaacgtgcagagacaatcccagggcggcaacggacggggaggctataatctgagacccaggacctaccagccccagagatacggcggaggcagaggcagaaggtggaacgaccagcctgccagatcagacaaccagcagcggtcccaatctcaacagcctcagtccgaggctagaggcgagcagagcagaaccagcggagccggcagaggacagggcggccgggggaatcaaaacagaaaccagagaagcgccggtggcaatgccgacagaacagtgaacaccgtgacaaccgccagcgcttctacaagcgcctcaggtcaagatggatcctctccagctcctccagcctctggaagcggaaatcaagggaactaaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1130 - DNA, 4977 bp, synthetic construct
  misc_feature 1..4977: note = pXDP84 sequence
  source 1..4977: mol_type = other DNA
atggccgccatcgagggcgatctggacgtgcaggccctggctaacctgttcaacgacctgggcatcaacagaaaccccagacacagagaggtgattgccctgagaatgaccggcggctggtggggccccgctaccagatataatctggtgagcctgctgctgcaggacgaccagggccagcctctgccacagcccagatggcgggctgaaggcagagccgcaaaccccgccgtgatgttcaccctggaagccccctggcaggatctgagactggcctttgacaatatcgacgtgggcgagggcacactgagattcggcccacttgctaacggcaactacatccccggcgacgagttcagcctggagttcctgcctcctgccatgcaggagatcacacagatgcagagagatgagctggaggaagtgctggatgtggtgggccagatcacaatgcagatgaacgacctgatcggcatgcaggacgcccagatccggggactggaaggacaactgagaggactgagaggcaatctgccagtggccggcacacctccacctcctccacccagcctggacctgcagcctgctgccgccagcagcccctacgtggcccctgcaccttccgctcctgctgcctctgccgccgcagccgacctgggatggttcgccggaggccctggccctggatctctggacccccgcctcgcccgggtggcctacaacccctttctgcctggccctagcgacggcagcggtgccgctcccgcccagcctagcgctcctccggtggcctctcctctgccttctctgctgcctgcccagcccatgcaacctgtgatccagtacgtgcaccccccacctatcaatcctgctcaacaggtgatccctattcagcatatcagagccgtgaccggcaacgcccctagcaacccaagagaaatccctatgtggatcggaagaaacgccagcgccatcgagggcgtgttccccatccctacatctgacatccgttctagagtgatcaacgccctgctgggtagacagctgggcctgaacctggatcctcagcactgcatcacctgggccagcgcaatcgccactctgtacgtgcgcacccacggcagctaccctctgcaccagctggccgaggttctgcggagagtctccaacagcgaaggcgcggccgccgcctggcagctgggcatgatgctgaccaaccaggactacaacctcgtgtggggaatggtcagacccctgctgcccggccaggctgtggtcaccgccatgcagcaccggctggatcaggaggtttctgatgccgccagaatcgtgtccttcgtgaaccacctgaacgccgtgtacgagctgctgggcctgaatgccagaggccagaacctcagggtctccaccggcggccagaccaccgctagaacaagcgccggcagaggcgccagaggcagacggtcccagcaggggacccctggcaggcagtctagcggacaggcccctcctcaaggccggagaagcagccagggccagcagcctaggcagtctgagagcggcgaccagaacaaccagcggcagctccagggaggaaacaaccggggcggctataacctgcggcctcggacataccagcctcagcggtacgggggaggccggggccggagatggaacgatcagaccgccagagccgataaccagcagcggagccaatcccaacaacctcagagcgaggcccggggcgagcagagcagaaccagcggcgccggcagagaacagggcggcagaggcaatcaaaatcggaatcaaagatctgccggagaaaacaccgacagatccgtgaacaccgtgacagccaccagcgccagcatcagcgcctcaggtcaaaatggatcctctacaactcctccagcctctggaagcggaaatcaagggaactaaggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1131 - DNA, 19 bp, synthetic construct
  misc_feature 1..19: note = MS2 hairpin
  source 1..19: mol_type = other DNA
acatgaggatcacccatgt

SEQ ID NO: 1132 - DNA, 19 bp, synthetic construct
  misc_feature 1..19: note = MS2 hairpin
  source 1..19: mol_type = other DNA
cgtacaccatcagggtacg

SEQ ID NO: 1133 - DNA, 116 bp, synthetic construct
  misc_feature 1..116: note = sgRNA
  source 1..116: mol_type = other DNA
actggcgcttttatctgattactttgagagccatcaccagcgactatgtcgtagtgggtaaagctcacatgaggatcacccatgtgagcatcaaagcgagacgtaattacgtctcg

SEQ ID NO: 1134 - DNA, 120 bp, synthetic construct
  misc_feature 1..120: note = sgRNA
  source 1..120: mol_type = other DNA
actggcgcttttatctgattactttgagagccatcaccagcgactatgtcgtagtgggtaaagctccccgtacaccatcagggtacggggagcatcaaagcgagacgtaattacgtctcg

SEQ ID NO: 1135 - DNA, 116 bp, synthetic construct; identical to SEQ ID NO: 1133
  misc_feature 1..116: note = sgRNA
  source 1..116: mol_type = other DNA

SEQ ID NO: 1136 - DNA, 116 bp, synthetic construct; identical to SEQ ID NO: 1133
  misc_feature 1..116: note = sgRNA
  source 1..116: mol_type = other DNA

SEQ ID NO: 1137 - DNA, 120 bp, synthetic construct; identical to SEQ ID NO: 1134
  misc_feature 1..120: note = sgRNA
  source 1..120: mol_type = other DNA

SEQ ID NO: 1138 - DNA, 4560 bp, synthetic construct; identical to SEQ ID NO: 1022
  misc_feature 1..4560: note = Gag-CasX491-Hatag
  source 1..4560: mol_type = other DNA

SEQ ID NO: 1139 - DNA, 1763 bp, synthetic construct
  misc_feature 1..1763: note = Gag-(-1)-PR
  source 1..1763: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaatttttaa

SEQ ID NO: 1140 - DNA, 1902 bp, synthetic construct
  misc_feature 1..1902: note = Gag-MS2
  source 1..1902: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacttataa

SEQ ID NO: 1141 - DNA, 2366 bp, synthetic construct
  misc_feature 1..2366: note = Gag-MS2-p1/p6-(-1)-PR
  source 1..2366: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacttatttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaatttttaa

SEQ ID NO: 1142 - DNA, 3033 bp, synthetic construct
  misc_feature 1..3033: note = SV40NLS-CasX491-SV40 NLS
  source 1..3033: mol_type = other DNA
gccaccatgccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttaa

SEQ ID NO: 1143 - DNA, 2420 bp, synthetic construct
  misc_feature 1..2420: note = pSG60 sequence
  source 1..2420: mol_type = other DNA
gaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctcacatgaggatcacccatgtgagcatcaaagctgcattctagttgtggtttttttttttgaattcgctagctaggtctagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcccgacaggcccgaag

SEQ ID NO: 1144 - DNA, 4563 bp, synthetic construct
  misc_feature 1..4563: note = pXD17 sequence
  source 1..4563: mol_type = other DNA
atgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1145 - DNA, 1908 bp, synthetic construct
  misc_feature 1..1908: note = pXD276 sequence
  source 1..1908: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacgcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataa

SEQ ID NO: 1146 - DNA, 1908 bp, synthetic construct
  misc_feature 1..1908: note = pXD277 sequence
  source 1..1908: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcaggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataa

SEQ ID NO: 1147 - DNA, 1920 bp, synthetic construct
  misc_feature 1..1920: note = pXD278 sequence
  source 1..1920: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacgcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataa

SEQ ID NO: 1148 - DNA, 1920 bp, synthetic construct
  misc_feature 1..1920: note = pXD279 sequence
  source 1..1920: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcaggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataa

SEQ ID NO: 1149 - DNA, 1908 bp, synthetic construct
  misc_feature 1..1908: note = pXD280 sequence
  source 1..1908: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaatgcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataa

SEQ ID NO: 1150 - DNA, 1908 bp, synthetic construct
  misc_feature 1..1908: note = pXD281 sequence
  source 1..1908: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcgcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataa

SEQ ID NO: 1151 - DNA, 1920 bp, synthetic construct
  misc_feature 1..1920: note = pXD282 sequence
  source 1..1920: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaaggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataa

SEQ ID NO: 1152 - DNA, 1920 bp, synthetic construct
  misc_feature 1..1920: note = pXD283 sequence
  source 1..1920: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcgcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacgctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaataa

SEQ ID NO: 1153 - DNA, 2465 bp, synthetic construct
  misc_feature 1..2465: note = pSG17
  source 1..2465: mol_type = other DNA
gctagctaggtctagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctgcactatgggcgcagcgtcaatgacgctgacggtacaggccagacaattattgtctggtatagtgcagcatcaaagctgcattctagttgtggtttttttttttgaattc

SEQ ID NO: 1154 - DNA, 2420 bp, synthetic construct; identical to SEQ ID NO: 1143
  misc_feature 1..2420: note = pSG50
  source 1..2420: mol_type = other DNA

SEQ ID NO: 1155 - DNA, 2166 bp, synthetic construct
  misc_feature 1..2166: note = pXD354 sequence
  source 1..2166: mol_type = other DNA
gccaccatggaagccgtgatcaaggtgatcagctccgcatgcaagacctactgtggcaagacgagcccaagcaagaaggaaatcggcgctatgctgagcctgctgcagaaggagggcctcctgatgagcctgtctgatctgtacagcccaggtagctgggaccctatcaccgccgccctgacacagagagccatggtgctgggcaaaagcggcgagctgaagacatggggactggtgctgggcgccctgaaagccgctagagaagagcaagtaaccagcgagcaggccaagttctggctgggactgggcggcggtagagtgagcccccctggccctgagtgcatcgagaagcctgccaccgagcggcgcattgacaaaggcgaagaagtgggcgagacaaccgtgcagagagacgccaagatggctccagaagagacagcaaccccaaagaccgtgggcaccagctgctaccactgcggcaccgctatcggctgcaactgcgccaccgccagcgcgcctcctcccccgtatgtgggcagcggcctctacccctccctggcaggagtgggagagcagcagggccagggcggagatacacccagaggcgccgagcagcctagagccgaacaagacctcggagacctggaccatggcctcggcccgataggcttggacaaaatcagagaggagctggcctctacaggccctccagtggtcgccatgcctgtggtgatcaagaccgagggacctgcctggacccctctggaacctaaactgattacacggctggctgataccgtcagaaccaagggcctcagaagccccatcacaatggccgaagtggaagccctgatgagcagcccactgctgcctcacgacgtgaccaacctgatgcgggtgatcctgggccccgccccttacgccctgtggatggacgcctggggcgtgcagctgcaaacagttatcgccgccgccacaagagacccccggcacccagccaacggccagggcagaggcgagagaacaaacctggatcggctgaagggcctcgccgatggcatggccggcaatcctgagggccaggctgctctgctgagacccggggaactggttgctatcaccgccagcgccctgcaggccttcagagaagtggcccggctggccgagcctacagacccctgggccgagatcacccagggcccttctgagagcttcgtggacttcgccaacagactgatcaaggccgttgagggctccgacctgcctcctagcgcccgcgcccccgtgatcatcgactgttttagacagaaatcgcaacccgacatccagcagctgatccgggccgctccttctaccctgaccacacctggcgagatcatcaagtacgtgctggacagacagaagaccgcccccctgaccgacagaggaatcgccgccgccatgtctagcgccattcagcctctggtgatggccgtggtcaacagagaaagagatggacagacaggttctggcggcagagcccggggcctgtgctacacctgcggatcccctggacactaccaggcccagtgtcctaagaaaagaaagtctggtaacagcagagagcggtgccagctgtgtgatggcatgggccacaacgccaaacagtgccggagacgggacggaaaccaaggacaaagacccggccggggactgagcagcggaccttggcctgtcagccagcaacctgccgtgtccggtgccaccagctgctaccactgcggcaccggcggcagcgctagcaactttacccagttcgtgctggtggacaacggcggcactggcgatgtgacagtggcccccagcaacttcgccaacggcgtggctgagtggatctccagcaatagcagaagccaggcctataaggtgacatgcagcgtgagacagagctctgcccagaaccgcaaatacacaatcaaggttgaggtgcccaaagtggccacacagaccgtgggcggagtcgagctgcctgtggctgcttggcggtcctacctgaacatggaactgaccatccccatcttcgccaccaactccgattgtgaactgatcgtgaaggccatgcagggcctgctgaaagacggcaaccccatccctagcgccatcgccgctaattctggcatctactga

SEQ ID NO: 1156 - DNA, 2178 bp, synthetic construct
  misc_feature 1..2178: note = pXD355 sequence
  source 1..2178: mol_type = other DNA
gccaccatgggccaaatcttttcccgtagcgctagccctattccgcgaccgccccgggggctggccgctcatcactggcttaacttcctccaggcggcatatcgcctagaacccggtccctccaattgcgctttccacctgttaagaagatatcatgaaacagtttccggaataccggctcggatctgtcccattaactactccctcctagccagcctactcccaaaaggataccccggccgggtgaatgaaattttacacatactcatccaaacccaagcccagaagccgccctgtgcccaggcatagaagaagacacccgccgccgactactccacggattctgatccacaaatcccccctccctatgttgagcctacggccccccaagtccttccagtcatgcatccacatggtgctcctcctaaccatcgcccatggcaaatgaaagacctacaggccattaagcaagaagtctcccaagcagcccctgggagcccccagtttatgcagaccatccggcttgcggtgcagcagtttgaccccactgccaaagacctccaagacctcctgcagtacctttgctcctccctcgtggcttccctccatcaccagcagctagatagccttatatcagaggccgaaacccgaggtattacaggttataacccattagccggtcccctccgtgtccaagccaacaatccacaacaacaaggattaaggcgagaataccagcaactctggctcgccgccttcgccgccctgccggggagtgccaaagacccttcctgggcctctatcctccaaggcctggaggagccttaccacgccttcgtagaacgcctcaacatagctcttgacaatgggctgccagaaggcacgcccaaagaccccatcttacgttccttagcctactccaatgcaaacaaagaatgccaaaaattactacaggcccgaggacacactaatagccctctaggagatatgttgcgggcttgtcagacctggacccccaaagacaaaaccaaagtgttagttgtccagcctaaaaaaccccccccaaatcagccgtgcttccggtgcgggaaagcaggccactggagtcgggactgcactcagcctcgtcccccccccgggccatgccccctatgtcaagacccaactcactggaagcgagactgcccccgcctaaagcccactatcccagaaccagagccagaggaagatgccctcctattagacctccccgctgacattccacacccaaaaaactccatagggggggaggtttaacctccccccccacattacagcaagtctttcttaaccaagacccagcatctattctgtccagttataccgttagatcccgcccgtcggcccgtaattaaagcccaggttgacacccagaccagccacccaaagactatcgaagctctactagatacaggagcagacatgacagtccttccgatagccttgttctcaagtaatactcccctcaaaaatacatccgtattaggggcagggggccaaacccaagatcactttaagctcacctcccttcctgtgctaatacgcctccctttccggacaacgcctattgttttaacatcttgcctagttgataccaaaaacaactgggccatcataggtcgcgatgccttacaacaatgccagggcgtcctgtacctccctgaggcaaaagggccgcctgtaatcttgccaatacaggcgccagccgtcctttcccctcaagtgctgccagtgatgcacggcggcagcgctagcaactttacccagttcgtgctggtggacaacggcggcactggcgatgtgacagtggcccccagcaacttcgccaacggcgtggctgagtggatctccagcaatagcagaagccaggcctataaggtgacatgcagcgtgagacagagctctgcccagaaccgcaaatacacaatcaaggttgaggtgcccaaagtggccacacagaccgtgggcggagtcgagctgcctgtggctgcttggcggtcctacctgaacatggaactgaccatccccatcttcgccaccaactccgattgtgaactgatcgtgaaggccatgcagggcctgctgaaagacggcaaccccatccctagcgccatcgccgctaattctggcatctactga

SEQ ID NO: 1157 - DNA, 2190 bp, synthetic construct
  misc_feature 1..2190: note = pXD356 sequence
  source 1..2190: mol_type = other DNA
gccaccatgggcgatcctctgacatggagcaaggccctgaagaagctggagaaggtgaccgtgcagggcagccagaagctgaccacaggcaactgcaattgggccctgtccctggtggacctgttccacgatacaaactttgtgaaggagaaggattggcagctgcgcgacgtgatcccactgctggaggacgtgacccagacactgtctggccaggagcgggaggccttcgagagaacctggtgggccatcagcgccgtgaagatgggcctgcagatcaacaatgtggtggatggcaaggcctcttttcagctgctgagggccaagtacgagaagaagacagccaacaagaagcagtctgagcctagcgaggagtatccaatcatgatcgacggcgccggcaaccggaatttcagaccactgacccccagaggctacaccacatgggtgaacacaatccagaccaacggcctgctgaatgaggcctcccagaatctgttcggcatcctgagcgtggattgtacctccgaggagatgaatgcctttctggacgtggtgccaggacaggcaggacagaagcagatcctgctggacgccatcgataagatcgccgacgattgggataaccggcacccactgcccaatgcacctctggtggcaccacctcagggacctatcccaatgacagccaggtttatcaggggactgggagtgccacgggagagacagatggagcccgccttcgaccagtttaggcagacctaccgccagtggatcatcgaggccatgagcgagggcatcaaagtgatgatcggcaagccaaaggcacagaacatcaggcagggagccaaggagccctatcctgagttcgtggatagactgctgtcccagatcaagtctgagggccaccctcaggagatctccaagtttctgaccgacacactgaccatccagaacgccaatgaggagtgccggaatgccatgcggcacctgagaccagaggataccctggaggagaagatgtacgcctgtagagacatcggcaccacaaagcagaagatgatgctgctggccaaggccctgcagacaggcctggccggaccattcaagggaggcgccctgaagggcggccccctgaaggccgcccagacctgctataactgtggcaagccaggacacctgagctcccagtgcagggcaccaaaggtgtgcttcaagtgtaagcagcctggccacttttctaagcaatgcagaagtgttccaaaaaacgggaagcaaggggctcaagggaggccccagaaacaaactttcccgatacaacagaagagtcagcacaacaaatctgttgtacaagagactcctcagactcaaaatctgtacccagatctgagcgaaataaaaaaggaatacaatgtcaaggagaaggatcaagtagaggatctcaacctggacagtttgtgggagacatataacctggagaagcgccccaccacaatcgtgctgatcaacgacacccctctgaacgtgctgctggacacaggagctgatacatctgtgctcaccaccgcccactacaaccggctgaagtacagaggcagaaagtaccagggcaccggcatcatcggcgtgggcggaaatgtggaaaccttcagcaccccagtgaccattaagaaaaagggccggcacatcaaaaccagaatgctggtcgccgacatccctgtgacaatcctgggcagagatatccttcaggacttaggtgcaggtgccagcgaggagtatccaatcatgatcggcggcagcgctagcaactttacccagttcgtgctggtggacaacggcggcactggcgatgtgacagtggcccccagcaacttcgccaacggcgtggctgagtggatctccagcaatagcagaagccaggcctataaggtgacatgcagcgtgagacagagctctgcccagaaccgcaaatacacaatcaaggttgaggtgcccaaagtggccacacagaccgtgggcggagtcgagctgcctgtggctgcttggcggtcctacctgaacatggaactgaccatccccatcttcgccaccaactccgattgtgaactgatcgtgaaggccatgcagggcctgctgaaagacggcaaccccatccctagcgccatcgccgctaattctggcatctactga

SEQ ID NO: 1158 - DNA, 2553 bp, synthetic construct
  misc_feature 1..2553: note = pXD357 sequence
  source 1..2553: mol_type = other DNA
gccaccatggaagccgtgatcaaggtgatcagctccgcatgcaagacctactgtggcaagacgagcccaagcaagaaggaaatcggcgctatgctgagcctgctgcagaaggagggcctcctgatgagcctgtctgatctgtacagcccaggtagctgggaccctatcaccgccgccctgacacagagagccatggtgctgggcaaaagcggcgagctgaagacatggggactggtgctgggcgccctgaaagccgctagagaagagcaagtaaccagcgagcaggccaagttctggctgggactgggcggcggtagagtgagcccccctggccctgagtgcatcgagaagcctgccaccgagcggcgcattgacaaaggcgaagaagtgggcgagacaaccgtgcagagagacgccaagatggctccagaagagacagcaaccccaaagaccgtgggcaccagctgctaccactgcggcaccgctatcggctgcaactgcgccaccgccagcgcgcctcctcccccgtatgtgggcagcggcctctacccctccctggcaggagtgggagagcagcagggccagggcggagatacacccagaggcgccgagcagcctagagccgaaccagggcatgcaggtcaagctcctgggcctgctctcactgattgggcacgcatcagagaggagctggcctctacaggccctccagtggtcgccatgcctgtggtgatcaagaccgagggacctgcctggacccctctggaacctaaactgattacacggctggctgataccgtcagaaccaagggcctcagaagccccatcacaatggccgaagtggaagccctgatgagcagcccactgctgcctcacgacgtgaccaacctgatgcgggtgatcctgggccccgccccttacgccctgtggatggacgcctggggcgtgcagctgcaaacagttatcgccgccgccacaagagacccccggcacccagccaacggccagggcagaggcgagagaacaaacctggatcggctgaagggcctcgccgatggcatggccggcaatcctgagggccaggctgctctgctgagacccggggaactggttgctatcaccgccagcgccctgcaggccttcagagaagtggcccggctggccgagcctacagacccctgggccgagatcacccagggcccttctgagagcttcgtggacttcgccaacagactgatcaaggccgttgagggctccgacctgcctcctagcgcccgcgcccccgtgatcatcgactgttttagacagaaatcgcaacccgacatccagcagctgatccgggccgctccttctaccctgaccacacctggcgagatcatcaagtacgtgctggacagacagaagaccgcccccctgaccgacagaggaatcgccgccgccatgtctagcgccattcagcctctggtgatggccgtggtcaacagagaaagagatggacagacaggttctggcggcagagcccggggcctgtgctacacctgcggatcccctggacactaccaggcccagtgtcctaagaaaagaaagtctggtaacagcagagagcggtgccagctgtgtgatggcatgggccacaacgccaaacagtgccggagacgggacggaaaccaaggacaaagacccggccggggactgagcagcggaccttggcctgtcagccagcaacctgccgtgtccctggctatgaccatggaacacaaggaccggcctctggtgcgggtgatcctgacaaataccggctctcaccccgtgaagcagcggtcagtgtacatcacagccctgctggacagcggcgctgatatcaccatcattagcgaggaggactggcctaccgactggcccgtgatggaagctgccaatccccagatccacggcatcggaggcggaatcccgatgagaaagtccagagacatgatcgaggtgggcgtgatcaaccgggacggctctcttgagagacctctgctgctgttccccgccgtggctatggtgcgaggcagcatcctgggccgcgactgcctgcagggcctgggcctgagactgaccaacctgaactttagccagggtgccaccagctgctaccactgcggcaccggcggcagcgctagcaactttacccagttcgtgctggtggacaacggcggcactggcgatgtgacagtggcccccagcaacttcgccaacggcgtggctgagtggatctccagcaatagcagaagccaggcctataaggtgacatgcagcgtgagacagagctctgcccagaaccgcaaatacacaatcaaggttgaggtgcccaaagtggccacacagaccgtgggcggagtcgagctgcctgtggctgcttggcggtcctacctgaacatggaactgaccatccccatcttcgccaccaactccgattgtgaactgatcgtgaaggccatgcagggcctgctgaaagacggcaaccccatccctagcgccatcgccgctaattctggcatctactgatga

SEQ ID NO: 1159 - DNA, 2142 bp, synthetic construct
  misc_feature 1..2142: note = pXD358 sequence
  source 1..2142: mol_type = other DNA
gccaccatgggcaactctcctagctacaatccccctgccggcatctccccatctgactggctgaacctgctgcagtccgcccagcgcctgaatccaaggcctagcccatccgacttcacagatctgaagaactatatccactggtttcacaagacccagaagaagccttggaccttcacaagcggaggaccaacatcctgcccaccaggcagatttggaagggtgccactggtgctggccaccctgaacgaggtgctgtccaatgagggaggagcacctggagcctctgccccagaggagcagcctccaccctacgaccctccagccatcctgcccatcatctccgagggaaacaggaataggcacagggcatgggcactgagggagctgcaggatatcaagaaggagatcgagaataaggcccctggctctcaagtgtggatccagacactgcggctggccatcctgcaggcagacccaacccctgcagatctggagcagctgtgccagtacatcgccagccctgtggaccagaccgcccacatgacatccctgaccgcagcaatcgcagcagcagaggcagcaacacccagcagagtgctgacccctaagaccggcacactgacccagcagtctgcccagccaaacgcaggcgatctgaggagccagtatcagaatctgtggctgcaggccggcaagatctccctgctggtgctgcagctgcagccctggtctaccatcgtgcagggacctgcagagagctccgtggagtttgtgaaccgcctgcagatctccctggccgacaacctgccagatggcgtgctgcggaatcccctgctgacacctctggtcatgcagatgctgaccgagtctgtgagcaagttctgcaggggagaggccagcggaaggggaggagccaagacagcaggactgagaaccatcggaccacctaggatgaagcagcctgccctgctggtgcacaccccaggaccaaagatgcctggaccacgccagccagcacctaagaggccaccacctggaccttgctacagatgtctgaaggagggacactgggccagggactgcccaacaaaggcaaccggcccaccacctggaccatgccccatctgtaaggacccaagccactggaagcgcgattgtcccacactgaagtccaagaatctaatagaggggggacttagcgccccccaaaccataacacctataacagattctcttagtgaggccgaattagaatgcttactctctattcctctggcccggagccgccctagcgtggccgtgtacctgagcggcccttggctgcaaccttctcagaaccaggccctgatgctggttgatacaggcgccgagaacaccgtgctgcctcagaattggctggtgcgggactaccccagaatccctgccgctgtgctgggagccggaggcgtgtcccggaacagatacaactggctgcagggccctcttacactggctctgaaacctgaaggcccattcatcaccatcccaaagatcctggtcgacaccttcgacaagtggcagatcctgggcagagatgtgctgagcagactgcaggccagcatcagcatccccgaggaagtgcggccccccgtggtgggcgtcttggatgcccccccgagccacattggattagaacatctgccccccccacctgaggtgcctcaattccctttaaacccagccatcctgcccatcatctccggcggcagcgctagcaactttacccagttcgtgctggtggacaacggcggcactggcgatgtgacagtggcccccagcaacttcgccaacggcgtggctgagtggatctccagcaatagcagaagccaggcctataaggtgacatgcagcgtgagacagagctctgcccagaaccgcaaatacacaatcaaggttgaggtgcccaaagtggccacacagaccgtgggcggagtcgagctgcctgtggctgcttggcggtcctacctgaacatggaactgaccatccccatcttcgccaccaactccgattgtgaactgatcgtgaaggccatgcagggcctgctgaaagacggcaaccccatccctagcgccatcgccgctaattctggcatctactga

SEQ ID NO: 1160 - DNA, 2334 bp, synthetic construct
  misc_feature 1..2334: note = pXD359 sequence
  source 1..2334: mol_type = other DNA
gccaccatgggccagacaatcacaacccctctgagcctgaccctggaccactggagtgaagtgcgggctagagcccacaaccagggcgtggaagtccggaaaaaaaagtggatcaccctgtgcgaggccgagtgggtcatgatgaacgtgggatggcctagagagggtacatttagcctggacaacatcagccaggttgagaaaaagattttcgctcctggcccttacggccatcctgaccaggtgccttacatcaccacatggcggagcctggctaccgacccaccaagctgggtgcggcccttcctgcctcctcccaagccccccacccctctgcctcagcctctgagcccccagccctctgcccctctgaccagctctctgtaccctgtgctgcctaagtccgatccccctaaacctcctgttttacctcccgaccctagcagcccactgatcgacctgctgacggaagaacctcctccttatcctggcggacatggccccccaccttctggccctcggaccccaaccgcctcccctatcgcctctagactgagagagcggagagaaaaccccgccgaagagtcccaagccctgcccctgagagagggccctaacaaccggcctcagtactggcccttcagcgccagcgatctgtataactggaagtcccacaatcctcctttcagccaggatcctgtggccctgacaaacctgatcgagtctatcctggtgactcaccagccaacctgggatgactgccagcagctgctgcaggccctcctgaccggcgaagagagacagagagtgctgctggaggccagaaagcaggtgcctggagaggacggcaggcctacccagctgcctaatgtgatcgacgagacattccccctgaccagaccaaattgggacttcgccaccccagctggcagagagcacctgcgcctgtaccggcagcttctgctggccggactgagaggcgctgccagaagaccaaccaacctggctcaggtgaagcaggtcgtgcagggcaaagaggagacacccgccgctttcctggaacggctgaaggaggcctacagaatgtacaccccttacgaccccgaagatccaggacaggccgccagcgtgatcctgagcttcatctaccagagcagccctgacatcagaaacaagctgcagcggctggaaggcctgcagggcttcacactgagcgacctgctcaaggaggccgagaagatctacaacaagcgggaaacccctgaggaaagagaagagagattgtggcagcggcaagaggagcgggacaaaaagcggcacaaggaaatgaccaaggtgctggctaccgtggtggcccagaacagagataaagacagagaggaatcgaagctgggcgaccagagaaagatcccccttggcaaggaccaatgtgcctactgcaaggaaaaaggccactgggtgagggactgtcccaagagacccagaaagaagcccgcaaacagcacactgctgaacctgggcgatcaggagagccaaggccaggacccccctcctgagcctagaatcaccctgaagattggaggccagcctgtgacctttctggtggacaccggcgcccaacactctgtgctgaccagacctgatggccccctcagcgatagaaccgccctggtccagggagctacaggcagcaagaactacagatggaccaccgacagaagggtgcagctggctactggcaaggtgacacacagctttctgtacgtgcccgagtgcccttaccccctcctgggcagagatctgttgacaaagctgaaggcccaaatccacttcaccggagagggcgctaatgtggtgggccccaagggcctgcctcttcaggtgctgacactgcaactggaagagggtgccagctctctgtaccctgtgctgcctggcggcagcgctagcaactttacccagttcgtgctggtggacaacggcggcactggcgatgtgacagtggcccccagcaacttcgccaacggcgtggctgagtggatctccagcaatagcagaagccaggcctataaggtgacatgcagcgtgagacagagctctgcccagaaccgcaaatacacaatcaaggttgaggtgcccaaagtggccacacagaccgtgggcggagtcgagctgcctgtggctgcttggcggtcctacctgaacatggaactgaccatccccatcttcgccaccaactccgattgtgaactgatcgtgaaggccatgcagggcctgctgaaagacggcaaccccatccctagcgccatcgccgctaattctggcatctactga

SEQ ID NO: 1161 - DNA, 3009 bp, synthetic construct
  misc_feature 1..3009: note = pXD360 sequence
  source 1..3009: mol_type = other DNA
gccaccatgggcgtgtccggctcaaagggccagaagctgtttgtgtccgtgctgcagcgtctgctgtccgaacggggcctacacgtgaaagagagcagcgccatcgagttctaccagtttctgatcaaggtgtcaccctggttccccgaggaaggcggcctgaatctgcaggattggaagagagtgggcagagaaatgaagaagtacgccgctgagcacggcaccgacagcatccccaagcaggcttatcctatctggctgcaactgagagagatcctgacagagcaatctgacctggtgctgctgagcgccgaggccaagtccgtgacagaggaagaactggaagaaggcctgacaggactgctgagcgccagcagccaggagaagacctacggcacaagaggcaccgcctatgccgaaatcgacaccgaggtggataagctgagcgagcacatctacgacgagccctacgaggagaaggaaaaggccgacaagaacgaggagaaggaccacgtgcggaaggtcaagaagatcgtgcaaagaaaggaaaatagcgagcataagagaaaggagaaagatcagaaggccttcctggcaaccgactggaacaacgacgacctgagccctgaggactgggacgacctggaagagcaggccgcccactaccacgatgacgacgaactgatcctgcctgtgaagagaaaggtggacaagaagaagccgctcgccctgaggcggaaacctctgcccccggttggcttcgccggagccatggccgaggctagagagaagggcgatctgaccttcacatttcccgtggttttcatgggagaatccgacgacgatgatacccctgtgtgggaacctctgcccctgaagacactgaaggaactgcagtctgccgtgcggaccatgggccctagcgccccttacaccctccaggtggtggacatggttgcctctcagtggctgacacctagcgattggcaccaaaccgccagagccaccctgtctcctggggactacgtgctgtggcggaccgagtacgaggagaagagcaaggaaaccgtgcagaagaccgctggcaagcggaaaggcaaggtgagcctggatatgctgctgggcacaggtcagttcctgagcccttcttctcagatcaagctttctaaagatgtgctgaaggatgtgaccaccaacgccgtcctggcctggagagccatccctcctccaggcgtcaaaaagacagtgctggccggactcaagcagggaaatgaggaaagctacgagacattcatcagcagactggaagaggccgtgtacagaatgatgcctagaggagaaggcagcgacatcctgatcaagcagctggcttgggagaacgctaattctctgtgccaggacctgatccggcctatgcggaagaccggcaccatgcaggactacatcagagcctgtctggatgcctcccctgccgtggtgcagggcatggcctacgccgccgcaatgagaggacaaaagtacagcaccttcgtgaaacagacatacggcggcggaaaaggcggacagggctctgaaggccctgtgtgcttcagctgcggcaaaacaggtcacattaagcgggattgcaaggaagagaaaggaagcaagcgcgctcctcctggactgtgtcctagatgcaagaaaggctaccactggaagagcgagtgcaagagcaagttcgacaaggacggcaaccctctgccaccactggaaactaacgccgaaaacagcaaaaaccccacacagaaaggcgacaaaggaaaggacagcggactgaaccccgaagcccctcctttcaccatccacgacctgccacgaggcaccccaggcagtgccggcttggacctgagcagccagaaagacctgatcctgtctctggaagacggcgtgtccctggtgccaaccctggtgaagggcaccctgcccgagggcaccacgggactgatcatcggcagatccagcaactacaagaaaggcctggaggtgctgcccggcgtgatcgactccgacttccagggcgaaattaaggtcatggtaaaggccgctaagaacgccgtgatcatccacaagggcgagcggatcgcgcagctgctgctgctgccttatctgaaactgcctaaccctatcatcaaggaggaaagaggcagcgagggatttggcagcacctcccacgtgcactgggtgcaggagatcagcgacagcagacccatgctgcacatcagcctgaacggcagaagattcctgggcctgctggacaccggggccgataagacctgcatcgccggcagagattggcccgccaactggcctattcaccagaccgagagcagcctgcagggcttgggaatggcttgtggcgtggctagaagctctcagcctctgagatggcagcacgaggataagtctggcattatccatcctttcgtgatccccacattgccttttaccctctggggccgggacatcatgaaagagataaaggtgcggctgatgaccgatagcccagacgacagccaggatctgacatctctgtacggcttaggtgccgacctggtgctgctgagcgccgagggcggcagcgctagcaactttacccagttcgtgctggtggacaacggcggcactggcgatgtgacagtggcccccagcaacttcgccaacggcgtggctgagtggatctccagcaatagcagaagccaggcctataaggtgacatgcagcgtgagacagagctctgcccagaaccgcaaatacacaatcaaggttgaggtgcccaaagtggccacacagaccgtgggcggagtcgagctgcctgtggctgcttggcggtcctacctgaacatggaactgaccatccccatcttcgccaccaactccgattgtgaactgatcgtgaaggccatgcagggcctgctgaaagacggcaaccccatccctagcgccatcgccgctaattctggcatctactga

SEQ ID NO: 1162 - DNA, 2433 bp, synthetic construct
  misc_feature 1..2433: note = pXD361 sequence
  source 1..2433: mol_type = other DNA
gccaccatgggccagaccgtgaccacacccctgtccctgacactgggccactggaaggacgtggagcggatcgcccacaatcagtctgtggatgtgaagaagcggagatgggtgaccttctgcagcgccgagtggcccaccttcaacgtgggctggccaagggacggcaccttcaaccgcgatctgatcacacaggtgaagatcaaggtgtttagcccaggacctcacggacacccagaccaggtgccttatatcgtgacctgggaggccctggccttcgatccacctccatgggtgaagccatttgtgcacccaaagccacctccaccactgcctccatccgccccttctctgccactggagccacctcggtccaccccaccaagaagctccctgtatcctgccctgacaccatctctgggcgccaagccaaagccacaggtgctgtctgacagcggaggacctctgatcgacctgctgaccgaggatcctccaccctacagagatccaaggcctccaccatccgacagggatggaaacggaggagaggcaacaccagcaggagaggcccctgacccatcccccatggcctctagactgaggggcaggcgcgagcctccagtggcagatagcaccacatcccaggcattcccactgagggcaggaggaaatggccagctgcagtattggcccttttctagctccgacctgtacaactggaagaacaataacccatccttctctgaggatcccggcaagctgaccgccctgatcgagagcgtgctgatcacccaccagcccacatgggacgattgtcagcagctgctgggcaccctgctgacaggcgaggagaagcagcgggtgctgctggaggcaaggaaggccgtgagaggcgacgatggcagacccacccagctgcctaatgaggtggacgcagcatttccactggagaggccagactgggattataccacacaggccggcaggaaccacctggtgcactacaggcagctgctgctggccggactgcagaatgcaggcaggtcccctaccaacctggccaaggtgaagggcatcacacagggccctaatgagagcccatccgcctttctggagcgcctgaaggaggcctaccggagatataccccctacgaccctgaggatccaggccaggagacaaacgtgtctatgagcttcatctggcagtctgccccagacatcggaaggaagctggagcgcctggaggacctgaagaataagaccctgggcgatctggtgcgggaggcagagaagatcttcaacaagagagagacacctgaggagagggaggagcggatcaggagggagaccgaggagaaggaggagcggagaaggacagaggacgagcagaaggagaaggagcgggatcgccggagacacagagagatgagcaagctgctggccaccgtggtgtccggacagaagcaggacaggcagggaggagagaggcgccggtctcagctggaccgcgatcagtgcgcctactgtaaggagaagggccactgggccaaggattgccccaagaagcctagaggcccaaggggccctaggccacagaccagcctgctgacactggacgatcaaggaggacagggacaggagccacctccagagcccagaatcaccctgaaggtcggcggccagcctgtgacctttctggtggacacaggcgcccagcacagcgtgctgacccagaatcccggccctctgtctgataagagcgcctgggtgcagggagcaacaggcggcaagcggtacagatggaccacagaccggaaggtgcacctggccaccggcaaggtgacacacagctttctgcacgtgcccgactgtccataccccctgctgggcagagatctgctgaccaagctgaaggcacagatccacttcgagggatccggagcacaggtcatgggaccaatgggacagcctctgcaggtgctgacactgaacatcgaggatgagggtgccagctccctgtatcctgccctgacaggcggcagcgctagcaactttacccagttcgtgctggtggacaacggcggcactggcgatgtgacagtggcccccagcaacttcgccaacggcgtggctgagtggatctccagcaatagcagaagccaggcctataaggtgacatgcagcgtgagacagagctctgcccagaaccgcaaatacacaatcaaggttgaggtgcccaaagtggccacacagaccgtgggcggagtcgagctgcctgtggctgcttggcggtcctacctgaacatggaactgaccatccccatcttcgccaccaactccgattgtgaactgatcgtgaaggccatgcagggcctgctgaaagacggcaaccccatccctagcgccatcgccgctaattctggcatctactga

SEQ ID NO: 1163 - DNA, 3183 bp, synthetic construct
  misc_feature 1..3183: note = pXD362 sequence
  source 1..3183: mol_type = other DNA
gccaccatggggcaagaattaagccagcatgaacgttatgtagaacaattgaagcaggctttaaagacacggggagtaaaggttaaatatgctgatcttttgaaattttttgattttgtgaaggatacttgtccttggtttccgcaagagggaaccatagatattaaacggtggcgtagagtaggcgactgtttccaagactattacaatacttttggcccggagaaagtcccagtaactgcattctcttactggaacttaattaaagaattgatagataagaaagaagttaacccacaagtaatggctgccgtagcccaaactgaagaaattttaaaaagtaattctcaaacagacctcacaaagacctctcaaaacccagacttggaccttatttcccttgatagcgacgatgaaggagctaaaagttcctctctacaagataaaggtttatcaagtactaaaaaaccaaaaagattcccagttctgttaacagcacaaactagtaaagaccctgaagaccccaacccctcagaggtagactgggacggcttggaagatgaggcagcgaaatatcataatcccgattggcctcccttcctaacccgtccacctccttacaataaagctactccttccgcacccactgtaatggcggttgttaatccaaaagaggagctcaaagaaaaaattgctcaattagaggaacagattaaattagaagagttacaccaggcactaatttccaaattacaaaaactaaaaacagggaatgaaactgtaactcacccagacacagcaggaggcctttctcgcacgcctcactggccagggcaacatatccctaaaggaaaatgttgcgccagtcgagaaaaggaagaacaaatcccaaaagatattttcccagtgactgaaaccgttgatgggcaaggtcaagcctggagacaccataatggttttgattttgccgtcataaaagaattaaaaacagctgcttcccaatatggggctactgccccatacacattagccatagtggaatctgtagcggacaattggcttacccctacagattggaatacgcttgttagggcagtcctctcaggaggagatcacttactgtggaaatctgagttttttgaaaattgcagagatacggctaaaagaaaccaacaagccggtaatggctgggattttgacatgttaacaggttcgggtaattattccagcaccgatgcacaaatgcagtatgatccaggattgtttgctcaaattcaagcggctgctacaaaagcctggagaaaacttcccgttaagggagacccaggagcctcccttacaggagtcaaacaaggacccgatgagccatttgcagatttcgtacacagacttataacaactgctgggagaatctttggaagtgctgaggccggtgtagactatgtaaaacaactagcatatgaaaatgctaatccagcttgtcaggcagccattcgcccctatagaaagaagacagatttaactggctatatccgtctttgctcggatattgggccctcttatcagcaaggcctggccatggccgccgcctttagcgggcagactgtaaaagattttcttaacaacaaaaataaagagaaaggagggtgttgctttaaatgcggtaaaaaaggacactttgcaaaaaattgtcatgaacatgcacataacaatgctgaaccaaaagttcccggactctgccctagatgtaaaagagggaaacattgggccaatgaatgcaaatccaaaactgataatcaaggaaacccaataccaccccatcagggaaacagagggccagccccaggccccgaaacaagcttatggggcagtcagctttgttccagccaacaaaaacaacccatttcaaagcttaccagagccaccccaggaagtgcaggattggacctctgttccacctcccacacagtattaacgcctgaaatggggccccaagcgttaagcactggaatatatggaccactgcctcccaacacttttggattaatcctaggccgaagtagcattactatgaagggtctacaagtttatccaggagtaattgataatgactataccggagaaattaaaattatggcaaaagctgttaacaatattgttactgtctctcaaggcaacagaatagctcaattaatcctcctgcctctgatcgagacagacaataaggtacaacaaccttatagaggacaaggaagttttggatcctcagacatatattgggtccaacctattacttgtcaaaaaccttccttaacattatggttagatgacaaaatgttcacaggcttaatagatacgggggctgatgtcacaattatcaagctggaggactggcctcctaattggcctataacagataccttaaccaatttaagaggaataggacaaagtaacaaccctaaacaaagttctaaatatcttacttggagagataaagaaaacaattctggtctcatcaaaccgtttgttattcctaacttacctgtcaatctttggggccgagatttactttctcaaatgaaaattatgatgtgtagccccaatgacatagtaactgctcaaatgttagcccagggctacagcccaggaaaagggttaggaaaaaaggaaaatggcattctacatcctatcccaaatcaaggacaatctaacaaaaaaggttttggaaattttctgcggccattgacatacttggtagccccacaggtgatggctgctgtcgccggcggcagcgctagcaactttacccagttcgtgctggtggacaacggcggcactggcgatgtgacagtggcccccagcaacttcgccaacggcgtggctgagtggatctccagcaatagcagaagccaggcctataaggtgacatgcagcgtgagacagagctctgcccagaaccgcaaatacacaatcaaggttgaggtgcccaaagtggccacacagaccgtgggcggagtcgagctgcctgtggctgcttggcggtcctacctgaacatggaactgaccatccccatcttcgccaccaactccgattgtgaactgatcgtgaaggccatgcagggcctgctgaaagacggcaaccccatccctagcgccatcgccgctaattctggcatctactga

SEQ ID NO: 1164 - DNA, 2541 bp, synthetic construct
  misc_feature 1..2541: note = pXD363 sequence
  source 1..2541: mol_type = other DNA
gccaccatggaggccgtgatcaaggtgatcagcagcgcatgcaagacctactgcggcaagaccagcccatctaagaaagagatcggcgccatgctgagcctgctccaaaaggaaggcctgctgatgagcccttccgacctgtacagccccggaagctgggacccaatcaccgctgccctgacccagcgggccatggtgctgggaaagagcggcgagctgaagacctggggcctggtgctgggagccctgaaggccgccagagaggaacaagtgacaagcgaacaggccaagttctggctgggactgggcggaggaagagtcagccctcctggcccagagtgcatcgagaagcccgctacagagagaagaatcgataagggcgaagaggtgggcgagacaacagtgcagagagacgccaagatggctcctgaggaaaccgccacacctaagaccgtgggcacatcttgttaccactgcggcaccgccattggatgtaactgcgctacagccagcgcaccaccaccaccatacgtgggcagcggactttatcctagcctggccggcgtgggagagcagcagggccaaggcggagatacacccagaggcgccgagcagcctagagccgaacaagacctcgtagaaccgggccttggcctagtccagataggttgggtcctcatccgggaagaactggcttctaccggccccccggtggtcgccatgcctgtggttatcaagacagagggccctgcttggacccctctggaaccaaagctgattacaagactcgccgacaccgtgcggaccaagggcctgcggagccctatcaccatggccgagatggaagctctgatgagcagcccactgctgccccacgacgtgaccaacctgatgagagtgatcctgggccccgccccttacgccctgtggatggacgcctggggggtgcagctgcagaccgtgattgccgccgccaccagagatcctagacaccctgctaacggccaaggcagaggcgaaagaaccaaccttgacagactgaaaggcctggccgatggaatggtcggcaacagcgaaggccaggccgccctgctgagacctggcgagctggtggctatcacagccagcgccctgcaggccttcagagaagtggcccgactggctgagcccacggacccttgggccgacatcatgcagggcccttctgagagcttcgtggacttcgccaatagactgatcaaggccgtcgagggcagcgatcttcctcctagcgcgagagcccctgttatcatcgactgcttccggcagaaaagccagcccgacatccaacagctgatcagagccgccccttccaccctgaccacaccaggcgagatcatcaagtacgtgctggatagacagaagaccgcccctctgaccgatcagggcatcgccgctgccatgtcctctgccatccagcctctggtgatggccgtggtgaacagagagagagacggccagacaggctccggcggccgggccagagagctgtgctacacctgtggctctccaggccactaccaggctcagtgtcctaaaaagcggaagtctggcaattctagagagcggtgccagctgtgcaacggcatgggccataatgccaaacagtgtcggaaacgggacggaaaccagggccagagaccaggcagaggcctgtcttctggcccctggcccggccctgagcctcctgctgtgtccctggctatgaccatggaacacaaggacagacccctggtgcgggtgatcctgacaaacaccggaagccaccccgtgaagcagcgctccgtgtacatcacagcccttctggacagcggcgccgacatcaccatcatcagcgaggaagattggcctacagactggcctgtgatggaagccgcaaacccccagatccacggcatcggcggaggtatacccatgcggaagagcagagacatgatcgagctgggcgtgatcaaccgggacggcagcctggaacggcccctgctgttgtttcctgctgtggctatggtgcggggaagcatcctgggcagagattgcctgcagggcctgggcctgcgcctgaccaacctgggtgccacatcttgttaccactgcggcaccggcggcagcgctagcaactttacccagttcgtgctggtggacaacggcggcactggcgatgtgacagtggcccccagcaacttcgccaacggcgtggctgagtggatctccagcaatagcagaagccaggcctataaggtgacatgcagcgtgagacagagctctgcccagaaccgcaaatacacaatcaaggttgaggtgcccaaagtggccacacagaccgtgggcggagtcgagctgcctgtggctgcttggcggtcctacctgaacatggaactgaccatccccatcttcgccaccaactccgattgtgaactgatcgtgaaggccatgcagggcctgctgaaagacggcaaccccatccctagcgccatcgccgctaattctggcatctactgatga

SEQ ID NO: 1165 - DNA, 1545 bp, synthetic construct
  misc_feature 1..1545: note = pXD364 sequence
  source 1..1545: mol_type = other DNA
gccaccatgggcgatcctctgacatggagcaaggccctgaagaagctggagaaggtgaccgtgcagggcagccagaagctgaccacaggcaactgcaattgggccctgtccctggtggacctgttccacgatacaaactttgtgaaggagaaggattggcagctgcgcgacgtgatcccactgctggaggacgtgacccagacactgtctggccaggagcgggaggccttcgagagaacctggtgggccatcagcgccgtgaagatgggcctgcagatcaacaatgtggtggatggcaaggcctcttttcagctgctgagggccaagtacgagaagaagacagccaacaagaagcagtctgagccttctgaagaataccctattatgattgatggcgccggcaaccggaatttcagaccactgacccccagaggctacaccacatgggtgaacacaatccagaccaacggcctgctgaatgaggcctcccagaatctgttcggcatcctgagcgtggattgtacctccgaggagatgaatgcctttctggacgtggtgccaggacaggcaggacagaagcagatcctgctggacgccatcgataagatcgccgacgattgggataaccggcacccactgcccaatgcacctctggtggcaccacctcagggacctatcccaatgacagccaggtttatcaggggactgggagtgccacgggagagacagatggagcccgccttcgaccagtttaggcagacctaccgccagtggatcatcgaggccatgagcgagggcatcaaagtgatgatcggcaagccaaaggcacagaacatcaggcagggagccaaggagccctatcctgagttcgtggatagactgctgtcccagatcaagtctgagggccaccctcaggagatctccaagtttctgaccgacacactgaccatccagaacgccaatgaggagtgccggaatgccatgcggcacctgagaccagaggataccctggaggagaagatgtacgcctgtagagacatcggcaccacaaagcagaagatgatgctgctggccaaggccctgcagacaggcctggccggaccattcaagggaggcggcagcagcgaggagtatccaatcatgatcggcggcagcgctagcaactttacccagttcgtgctggtggacaacggcggcactggcgatgtgacagtggcccccagcaacttcgccaacggcgtggctgagtggatctccagcaatagcagaagccaggcctataaggtgacatgcagcgtgagacagagctctgcccagaaccgcaaatacacaatcaaggttgaggtgcccaaagtggccacacagaccgtgggcggagtcgagctgcctgtggctgcttggcggtcctacctgaacatggaactgaccatccccatcttcgccaccaactccgattgtgaactgatcgtgaaggccatgcagggcctgctgaaagacggcaaccccatccctagcgccatcgccgctaattctggcatctactga

SEQ ID NO: 1166 - DNA, 2243 bp, synthetic construct
  misc_feature 1..2243: note = pXD366 sequence
  source 1..2243: mol_type = other DNA
gccaccatgggcgcgagaaactccgtcttgtcagggaaggaagcagatgaattagaaaaagttaggttacggcccaacggaaagaaaaagtatatgttgaagcatgtagtatgggcagcaaatgaattggacagatttggattagcagaaagcctgttggataacaaagaaggttgtcaaaaaattctttcagttttagctccattagttccgacaggttcagaaaacttaaagagcctttataatactgtctgcgtcatttggtgcattcacgcagaagagaaagtgaaacatactgaggaagcaaaacaaatagtgcagagacatctagtggtggaaacaggaacagcagacagaatgccagcaacaagcagaccaacagcaccacctagtggcagaggaggaaattacccagtgcagcaagtaggtggcaattatgtccacctacccttaagtccaagaacattaaatgcttgggtaaaattagtagaagagaaaaaatttggggcagaggtagtgccaggatttcaagcgctatcagaaggctgcactccctatgatattaatcaaatgctaaattgtgtaggagaacatcaggcagccatgcaaattattagagagattataaatgaagaagctgccgattgggatttacaacacccgcaaccaggtccactaccagcagggcaacttagagagccaagaggatcagacattgcaggaactactagtacagtagatgaacaaatccaatggatgtacaggcaacaaaaccccataccagtaggcaacatttatagaaggtggatccaattagggctgcagaaatgtgtaagaatgtataacccaacaaacattttagatgtgaaacaaggaccaaaagagccatttcaaagctacgtagatagattctacaaaagtctaagagcagagcaaacagatcccgcagtaaagaattggatgacccaaacactgctgattcaaaatgctaacccagattgtaaactagtgctcaagggtctgggcatgaatcccactttagaagaaatgctgacagcctgtcagggagtaggagggccaggacaaaaagctaggttaatggcagaagcattgaaagaggcactgaggccagatcaactcccatttgcagcagtccaacagaaaggacaaaggaagacaatcaagtgttggaattgtggaaaggagggacactctgcaaaacaatgcagggcccctagaagacagggctgctggaagtgtggaaaaacgggtcatgttatggccaaatgccctgaaagacaggcgggttttttagggcttggcccatggggaaagaagccccgcaatttccccatggcccagatgcctcaggggctgataccaactgctcccccagaggatccagctgtggatctactgaagaattacatgaagatgggcagaaagcagagggagaacagagagagaccttacaaggaggtgacagaggatttgctgcacctcaattctctctttggagaagaccagttgtcactgcctacattgaagaacagcccgtagaagtattattagatacaggggctgacgattcaattgtagcagggatagaattgggtccaaattatacccctaaaatagtaggaggaataggaggcttcattaacaccaaagaatataaagatgtaaaaataaaagtcttaggcaaggtaattaagggaacaattatgacgggagataccccaattaatatttttggcagaaatttgctaacagctatgggcatgtctttaaatctccccatagctaaggtggagggtgccggcggcaactaccccgtgcagcaaggcggcagcgcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttactga

SEQ ID NO: 1167 - DNA, 1902 bp, synthetic construct
  misc_feature 1..1902: note = pXD321 sequence
  source 1..1902: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcgtcaaacttcacgcagtttgtcctcgttgacaacggggggactggcgatgtcacagtggctcccagtaacttcgcgaatggcatcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacttataa

SEQ ID NO: 1168 - DNA, 1902 bp, synthetic construct
  misc_feature 1..1902: note = pXD335 sequence
  source 1..1902: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcgtcaaacttcacgcagtttgtcctcgttgacaacggggggactggcgatgtcacagtggctcccagtaacttcgcgaatggcgtcgccgaatggatcagcagtaactctcggtctcaggcatacagggtcacctgttccgtgcgccaatcatctgcccagaacaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacttataa

SEQ ID NO: 1169 - DNA, 1902 bp, synthetic construct
  misc_feature 1..1902: note = pXD336 sequence
  source 1..1902: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaagggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacttataa

SEQ ID NO: 1170 - DNA, 1902 bp, synthetic construct
  misc_feature 1..1902: note = pXD337 sequence
  source 1..1902: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaggaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacttataa

SEQ ID NO: 1171 - DNA, 1902 bp, synthetic construct
  misc_feature 1..1902: note = pXD338 sequence
  source 1..1902: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggtcgccacccagactgtgggaggggtggagctgcctgtggccgcctggaggtcatacctcagcatggagctcaccatacctatattcgcaaccaattccgactgcgaattgatcgtcaaagcgatgcagggcctcctgaaggatggtaacccaattccgagtgcaatcgcagctaacagcggcatttacttataa

SEQ ID NO: 1172 - DNA, 1902 bp, synthetic construct
  misc_feature 1..1902: note = pXD339 sequence
  source 1..1902: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacgccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacttataa

SEQ ID NO: 1173 - DNA, 1863 bp, synthetic construct
  misc_feature 1..1863: note = pXD340 sequence
  source 1..1863: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaacaggaaatacaccattaaggtggaggtgccaaaggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacttataa

SEQ ID NO: 1174 - DNA, 1902 bp, synthetic construct
  misc_feature 1..1902: note = pXD353 sequence
  source 1..1902: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcgtcaaacttcacgcagtttgtcctcgttgacaacggggggactggcgatgtcacagtggctcccagtaacttcgcgaatggcgtcgccgaatggatcagcagtaactctcggtctcaggcatacaaggtcacctgttccgtgcgccaatcatctgcccagaagaggaaatacaccattaaggtggaggtgccaaaggtcgccacccagactgtgggaggggtggagctgcctgtggccgcctggaggtcatacctcaacatggagctcaccatacctatattcgcaaccaattccgactgcgaattgatcgtcaaagcgatgcagggcctcctgaaggatggtaacccaattccgagtgcaatcgcagctaacagcggcatttacttataa

SEQ ID NO: 1175 - DNA, 1587 bp, synthetic construct
  misc_feature 1..1587: note = pXD366 sequence
  source 1..1587: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggatgcccaaacacgtcgccgtgagcggcgagcagagaaacaggcccaatggaaagctgcgaatggcggtagtttataa

SEQ ID NO: 1176 - DNA, 1692 bp, synthetic construct
  misc_feature 1..1692: note = pXD367 sequence
  source 1..1692: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggacgcccagacaaggcggagggagagacgagccgaaaagcaggcccagtggaaggccgctaacccattgctcgtcggcgttagcgcaaaaccagtgaaccgacccatcctgagtctgaacagaaagcccaagtcccgtgttgagtctgccttaaaccctatcgacctgacagtgctgttataa

SEQ ID NO: 1177 - DNA, 1893 bp, synthetic construct
  misc_feature 1..1893: note = pXD342 sequence
  source 1..1893: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaatctaaaaccatcgttcttgcggtcggcgaggctactcgcactctgactgagatccagtccaccgcagaccgtcagatcttcgaagagaaggtcgggcctctggtgggtcggctgcgcctcacggcttcgctccgtcaaaacggagccaagaccgcgtatcgcgtcaacctaaaactggatcaggcggacgtcgttgatgcatccaccagcgtcgccggcgagcttccgaaagtgcgctacactcaggtatggtcgcacgacgtgacaatcgttgcgaatagcaccgaggcctcgcgcaaatcgttgtacgatttgaccaagtccctcgtcgcgacctcgcaggtcgaagatcttgtcgtcaaccttgtgccgctgggccgtttataa

SEQ ID NO: 1178 - DNA, 1563 bp, synthetic construct
  misc_feature 1..1563: note = pXD368 sequence
  source 1..1563: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaatctggcccaaggcctcgaggaacgcgggggaaaggacgacgtattagacgcttataa

SEQ ID NO: 1179 - DNA, 4179 bp, synthetic construct
  misc_feature 1..4179: note = pXD369 sequence
  source 1..4179: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatgagtaacccgttcgcacacctggctgagccactggatccagtgcagccgggaaaaaaatttttcaaccttaacaagctggaagattctcgctatgggaggctgccatttagcatccgtgtgctgctcgaagccgccattaggaattgcgatgaattcttagtcaaaaaacaggatattgagaacatcctccactggaatgtcactcagcataaaaacatcgaagtgccattcaagcccgctcgagttattttacaagattttacaggagtgcccgctgtggtagatttcgcagccatgagggatgccgtcaaaaagctcgggggtgaccctgaaaaaatcaatccagtctgtccggctgacctggtcatagaccactcaattcaggtagatttcaataggagggccgacagcttgcagaagaaccaggacctggaattcgagcggaatcgggagcgtttcgaatttctgaaatggggatcccaggcatttcataacatgagaatcatcccacctggctccggaattatccaccaggttaatctcgaatatctcgctcgtgtcgtgtttgaccaagacggctactactatcctgatagcctcgtgggcactgatagccacactactatgattgacggccttggcattctcggctggggcgttggcggcatcgaggccgaagccgtaatgctcggccaacctatatccatggtgctgccccaggtgataggatatcggttgatgggtaaaccccaccccctggtgacgtctaccgacatagtcctcaccatcacaaaacacctgcggcaggtgggggttgtgggcaaattcgttgagttcttcggccccggcgtggcccagctgagtattgcggatcgagccactatagccaatatgtgccctgaatacggggccaccgccgcctttttcccagtcgacgaagtatccattacctacttggtgcagactgggcgcgacgaggagaaactcaaatacataaaaaagtaccttcaggctgtgggtatgtttagagacttcaatgacccaagtcaagatcctgattttacccaggtagtggagctggatctgaaaaccgtggtcccctgttgttcaggccctaagcgcccccaggacaaggtagccgtgagcgatatgaagaaagacttcgagtcctgcctcggagcgaagcagggcttcaagggctttcaagttgcccctgagcaccataatgatcacaaaactttcatctacgataacacggagttcacactggcccacggcagtgttgtgattgctgcaatcacatcctgcacaaacacttctaatccctccgtgatgctgggtgctggtcttctggctaagaaagctgtcgatgccggacttaacgttatgccttatatcaaaacctccttgtctcctggcagcggggttgttacatattacttgcaggagagtggggtcatgccctacttgtcacagctgggctttgatgtcgtgggatacggttgcatgacctgcattggcaactctggacctctgccggaacctgttgtggaagccatcacccaaggtgacctggtggcagtgggagtgctctcaggaaaccgcaacttcgagggcagggttcaccccaataccagagccaattaccttgccagccctccactcgttattgcgtatgccatagccggcaccatcaggatcgattttgagaaggagcccctgggggtgaacgccaaaggccagcaggtttttctgaaggatatttggcctactcgggacgagattcaagccgtcgagcgccaatacgtgatccccgggatgttcaaggaagtctatcagaagatcgagaccgtgaatgaatcatggaatgcactcgctacgccgtcagataaactgttcttttggaattccaagagcacatacattaagtccccaccctttttcgagaacctgaccttagaccttcagccccctaaatcaatagtggatgcatacgtgctgttaaatctgggcgattccgtaacgacagatcacatatcccccgcaggtaatatcgcccggaactcacccgccgcccggtacctgactaaccggggactcactcctagggaattcaatagctatggatctcggcgagggaatgacgcagtgatggccagaggaacttttgctaacattaggctcctcaatcgcttccttaacaagcaggcgcctcagactattcatctgccctccggcgaaattttagatgtctttgatgccgctgaaaggtatcagcaggccggccttcctcttatcgtcctggcaggaaaagaatacggggctggtagcagccgggactgggctgctaaggggccattcttgcttggcattaaggctgtgcttgcagaatcttatgaacgtattcacagatccaacctcgtcggaatgggcgtcataccactcgagtacctgcccggggaaaacgccgacgccttggggctgacgggacaagaacgttacaccatcatcataccagaaaatctcaaaccacagatgaaggtacaggtcaagctcgacaccggaaaaacttttcaggccgtgatgcggtttgatactgatgtggaactgacatatttcttgaatgggggaatcctgaactatatgattaggaagatggctaaattataa

SEQ ID NO: 1180 - DNA, 4401 bp, synthetic construct
  misc_feature 1..4401: note = pXD370 sequence
  source 1..4401: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggatgcacctaaggccggatacgcgtttgaatatttgatcgagaccctcaacgatagtagccataagaaattttttgatgttagtaaattgggcacaaaatatgatgtgctgccctactcaattcgcgtactgctggaggcggccgttagaaattgcgatgggttcctgatgaagaaggaggatgtgatgaatatcctggattggaagacaaagcagagtaacgtggaggtccccttctttccagcaagagttcttctgcaggatttcaccgggattcccgccatggtggactttgccgccatgcgggaggctgttaagacgctcggaggagatccagagaaggtgcatcccgcatgcccgacagacctcaccgtggaccatagtctgcagattgatttttctaagtgtgcgatccagaacgcacccaatcccgggggaggcgatctgcagaaggctggaaagcttagccctttgaaggtgcagcctaagaaactcccgtgccgcggacagactacttgccgcggcagctgcgacagtggggaattgggtcgcaatagcgggaccttctcttctcaaattgagaacacaccaattctgtgtccattccatcttcagccggtccctgagcccgaaaccgttcttaaaaatcaggaagttgagttcgggcggaaccgggagaggttgcaattctttaagtggagcagcagagttttcaaaaatgtagcagtgatacctcccggcactgggatggcccaccagatcaatcttgagtacctgtcccgagtcgtgtttgaagagaaggaccttctgtttcccgatagcgtggtcggaactgacagccacataaccatggttaacggactgggaatcctgggatggggagttgggggcatagagacggaggcggttatgttaggattgccagtgtctcttacactgcctgaagtagttggatgtgaattaacaggcagtagtaatccattcgtgactagtatcgacgtggttctgggcatcaccaaacatttgcgccaagtgggagttgctggtaaattcgtggagttctttggctctggcgtgtcacaactgtccatcgttgacaggacaactatcgccaacatgtgccctgaatacggggcaattctgagcttcttccctgtggacaatgtgactctcaaacacctggagcacaccggcttcagcaaggctaaattggagtccatggagacatatctgaaagcggtgaaactgttccgtaatgatcaaaattcctcaggcgaaccagagtactcccaggtgattcagattaatctgaattccatcgtccctagcgtgagtggacccaaacgtccccaggatagggtcgctgtgactgacatgaagagcgattttcaagcttgtctgaatgaaaaagtcggcttcaaggggttccagatagctgcggaaaaacagaaggacatagtgagcattcactacgagggatctgagtacaagctgagccacggaagtgtggtgattgcagccgtgataagctgcactaacaactgtaatcctagtgtgatgctcgccgccggcctcttagccaaaaaagcggttgaggccggcctgcgagtgaagccttatattcgtacatccctcagtccaggctctggcatggttacgcactacttgtcctcctccggggtcctgccttacctgtcaaaactcggcttcgagatcgttgggtacgggtgttcaatctgcgtgggaaacaccgcccccctgtctgatgctgttctgaatgctgtcaagcaaggcgatctggtgacttgtggtattcttagcgggaataagaacttcgaaggccgactttgcgattgcgtgcgtgccaactacttggcttcaccccccctggtggtggcctatgcgatcgccggcaccgtcaacattgactttcaaactgagccattgggcactgacccaactggcaagaatatctacttgcacgacatctggccttcacgggaagaagtgcatcgagttgaggaagagcacgtcattttatctatgtttaaggccctcaaggacaagatcgagatgggcaataagcgctggaactccctggaggcacccgactctgtgctgttcccctgggaccttaagtccacttatatacggtgtccgagtttcttcgacaagctgacaaaggagcccatcgcactgcaggctattgaaaatgcccacgtgctgctctatctgggtgatagtgtcaccaccgatcatatttcccctgcaggctccattgcaaggaattctgcagcagcaaaatacctgaccaacaggggccttacgccacgagagttcaactcttatggcgcaagacgcggcaacgatgcagtgatgactagaggtacgtttgccaacatcaagctgtttaacaaattcattggcaagcccgcccccaaaactatccactttccctcagggcagaccctcgacgtgttcgaggcagctgaattgtatcagaaggagggcataccactgatcatcctggccggtaagaagtacggcagcggcaatagtagagattgggctgcgaagggaccatacctgcttggcgtcaaagccgtgctggcggagagttacgagaagattcacaaagatcaccttataggcattgggattgccccactgcaattcctcccaggcgagaacgctgatagcctcggactgagcggtagggaaacgttctccttgacgtttcccgaagaactgtccccaggaattacacttaacattcagacgagcaccggaaaggttttttctgtgattgcttccttcgaagatgacgtggaaattaccctctacaaacacggcggtttactgaactttgtcgcccgtaagttttccttataa

SEQ ID NO: 1181 - DNA, 1815 bp, synthetic construct
  misc_feature 1..1815: note = pXD371 sequence
  source 1..1815: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggctgttccagagaccagacctaatcacaccatctacattaacaatttgaatgaaaagatcaaaaaagatgagctgaagaagagcctgtacgctatatttagccagttcggtcagattctggacatcctggtcagccgttccctcaagatgcggggacaggctttcgtgatcttcaaggaggtgagttctgccaccaacgccctccgatctatgcaaggatttcccttttacgataaaccaatgcggattcagtatgctaaaacagacagcgacatcatcgccaaaatgaaggggacttttttataa

SEQ ID NO: 1182 - DNA, 2358 bp, synthetic construct
  misc_feature 1..2358: note = pXD372 sequence
  source 1..2358: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggctgtgcccgaaacgcgccccaaccacacaatctatatcaataacctgaatgaaaagattaaaaaggatgaactcaaaaaatccctgtatgccattttctcccagtttggtcagattcttgatattcttgtgtctcgttccttgaaaatgcgaggccaggcgtttgtgatcttcaaggaagttagttctgcaaccaacgcgttgcggagtatgcagggcttccctttttacgacaaacccatgaggatccaatatgcgaagactgactctgacataatagcgaaaatgaagggtaccttcgtggaaagggacaggaaaagagagaaacgcaaaccgaagagtcaggagaccccggcaacgaagaaagccgtccagggcggaggagctacccctgttgtgggagccgtgcaggggccagtgcccggtatgcctccaatgacccaagcgcctcggatcatgcaccacatgcccggccagcctccatacatgcctccccccggcatgatccccccacctgggcttgctcctggacaaattcccccaggcgctatgcccccgcaacagctgatgccgggccagatgcccccagctcagcctctgtctgaaaaccccccgaaccatattctttttcttaccaacctgccagaggaaaccaatgaactcatgctgagcatgctgttcaatcagttccccgggttcaaggaggtgagactggtaccaggacggcacgacattgccttcgttgagtttgataacgaggttcaggctggcgccgctagggacgcattacaaggctttaaaatcactcagaataacgccatgaagatatccttcgctaaaaagttataa

SEQ ID NO: 1183 - DNA, 1911 bp, synthetic construct
  misc_feature 1..1911: note = pXD373 sequence
  source 1..1911: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggcaaagcttgagaccgttacacttggaaacattggcaaggacggtaagcaaactcttgtgcttaaccccagaggcgtaaaccccaccaatggggttgccagtcttagccaagccggcgcagtgcctgcactggagaaacgagtgactgtgagcgtctctcagccatcaagaaatcggaagaactataaggtgcaggtgaaaattcagaatccaacagcctgtaccgcaaacggcagctgtgacccatcagtaactagacaggcctatgcagatgtgactttcagtttcacccagtactctacagacgaggagcgggcctttgtgcggacagaactggccgccctgttggcttctcccttgttaattgacgcaattgatcaactgaaccccgcatacttataa

SEQ ID NO: 1184 - DNA, 1902 bp, synthetic construct
  misc_feature 1..1902: note = pXD362 sequence
  source 1..1902: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaatggctaccctcaggtctttcgtgctcgtcgacaacggcggcaccggtaatgttaccgtggtgccagtgtcaaacgccaatggagtggcggagtggttgtccaacaattcccgttctcaagcatacagggtcactgcctcctaccgcgctagcggggcggacaagcggaaatatgcgattaagcttgaggtacctaagatcgtaacacaggttgtcaacggagtggagctgccaggttcagcttggaaggcgtatgcttccatcgatcttacaatccccatcttcgcagccacagatgatgtgaccgttatcagcaagagtttggcggggctttttaaggtaggcaatccaatagcagaggctatcagttcccaatctggattctacgcgttataa

SEQ ID NO: 1185 - DNA, 15 bp, synthetic construct
  misc_feature 1..15: note = hairpin sequence
  source 1..15: mol_type = other DNA
gccctgaagaagggc

SEQ ID NO: 1186 - DNA, 23 bp, synthetic construct
  misc_feature 1..23: note = hairpin sequence
  source 1..23: mol_type = other DNA
aaggagtttatatggaaaccctt

SEQ ID NO: 1187 - DNA, 28 bp, synthetic construct
  misc_feature 1..28: note = hairpin sequence
  source 1..28: mol_type = other DNA
ggctcgtgtagctcattagctccgagcc

SEQ ID NO: 1188 - DNA, 30 bp, synthetic construct
  misc_feature 1..30: note = hairpin sequence
  source 1..30: mol_type = other DNA
ccgtgtgcatccgcagtgtcggatccacgg

SEQ ID NO: 1189 - DNA, 29 bp, synthetic construct
  misc_feature 1..29: note = hairpin sequence
  source 1..29: mol_type = other DNA
ggaatccattgcactccggatttcactag

SEQ ID NO: 1190 - DNA, 20 bp, synthetic construct
  misc_feature 1..20: note = hairpin sequence
  source 1..20: mol_type = other DNA
atgcatgtctaagacagcat

SEQ ID NO: 1191 - DNA, 23 bp, synthetic construct
  misc_feature 1..23: note = hairpin sequence
  source 1..23: mol_type = other DNA
aaaacataaggaaaacctatgtt

SEQ ID NO: 1192 - DNA, 98 bp, synthetic construct
  misc_feature 1..98: note = sgRNA with hairpin
  source 1..98: mol_type = other DNA
actggcgcttttatctgattactttgagagccatcaccagcgactatgtcgtagtgggtaaagctgcacgccctgaagaagggcgtgcagcatcaaag

SEQ ID NO: 1193 - DNA, 106 bp, synthetic construct
  misc_feature 1..106: note = sgRNA with hairpin
  source 1..106: mol_type = other DNA
actggcgcttttatctgattactttgagagccatcaccagcgactatgtcgtagtgggtaaagctgcacaaggagtttatatggaaacccttgtgcagcatcaaag

SEQ ID NO: 1194 - DNA, 111 bp, synthetic construct
  misc_feature 1..111: note = sgRNA with hairpin
  source 1..111: mol_type = other DNA
actggcgcttttatctgattactttgagagccatcaccagcgactatgtcgtagtgggtaaagctgcacggctcgtgtagctcattagctccgagccgtgcagcatcaaag

SEQ ID NO: 1195 - DNA, 113 bp, synthetic construct
  misc_feature 1..113: note = sgRNA with hairpin
  source 1..113: mol_type = other DNA
actggcgcttttatctgattactttgagagccatcaccagcgactatgtcgtagtgggtaaagctgcacccgtgtgcatccgcagtgtcggatccacgggtgcagcatcaaag

SEQ ID NO: 1196 - DNA, 113 bp, synthetic construct; identical to SEQ ID NO: 1195
  misc_feature 1..113: note = sgRNA with hairpin
  source 1..113: mol_type = other DNA

SEQ ID NO: 1197 - DNA, 109 bp, synthetic construct
  misc_feature 1..109: note = sgRNA with hairpin
  source 1..109: mol_type = other DNA
actggcgcttttatctgattactttgagagccatcaccagcgactatgtcgtagtgggtaaagctgcacagctatccattgcactccggatagctgtgcagcatcaaag

SEQ ID NO: 1198 - DNA, 103 bp, synthetic construct
  misc_feature 1..103: note = sgRNA with hairpin
  source 1..103: mol_type = other DNA
actggcgcttttatctgattactttgagagccatcaccagcgactatgtcgtagtgggtaaagctgcacatgcatgtctaagacagcatgtgcagcatcaaag

SEQ ID NO: 1199 - DNA, 106 bp, synthetic construct
  misc_feature 1..106: note = sgRNA with hairpin
  source 1..106: mol_type = other DNA
actggcgcttttatctgattactttgagagccatcaccagcgactatgtcgtagtgggtaaagctgcacaaaacataaggaaaacctatgttgtgcagcatcaaag

SEQ ID NO: 1200 - DNA, 165 bp, synthetic construct
  misc_feature 1..165: note = sgRNA
  source 1..165: mol_type = other DNA
actggcgcttttatctgattactttgagagccatcaccagcgactatgtcgtagtgggtaaagctgcactatgggcgcagcgtcaatgacgctgacggtacaggccacatgaggatcacccatgtggtatagtgcagcatcaaagcgagacgtaattacgtctcg

SEQ ID NO: 1201 - DNA, 175 bp, synthetic construct
  misc_feature 1..175: note = sgRNA
  source 1..175: mol_type = other DNA
actggcgcttttatctgattactttgagagccatcaccagcgactatgtcgtagtgggtaaagctgcactatgggcgcagctcatgaggatcacccatgagctgacggtacaggccacatgaggatcacccatgtggtatagtgcagcatcaaagcgagacgtaattacgtctcg

SEQ ID NO: 1202 - DNA, 165 bp, synthetic construct
  misc_feature 1..165: note = sgRNA
  source 1..165: mol_type = other DNA
actggcgcttttatctgattactttgagagccatcaccagcgactatgtcgtagtgggtaaagctgcactatgggcgcagcgtcaatgacgctgacggtacaggccacatgaggatcacccatgtggtatagtgcagcatcaaagctgcattctagttgtggttt

SEQ ID NO: 1203 - DNA, 175 bp, synthetic construct
  misc_feature 1..175: note = sgRNA
  source 1..175: mol_type = other DNA
actggcgcttttatctgattactttgagagccatcaccagcgactatgtcgtagtgggtaaagctgcactatgggcgcagctcatgaggatcacccatgagctgacggtacaggccacatgaggatcacccatgtggtatagtgcagcatcaaagctgcattctagttgtggttt

SEQ ID NO: 1204 - DNA, 58 bp, synthetic construct
  misc_feature 1..58: note = hairpin sequence
  source 1..58: mol_type = other DNA
cagcgtcaatgacgctgacggtacaggccacatgaggatcacccatgtggtatagtgc

SEQ ID NO: 1205 - DNA, 68 bp, synthetic construct
  misc_feature 1..68: note = hairpin sequence
  source 1..68: mol_type = other DNA
cagctcatgaggatcacccatgagctgacggtacaggccacatgaggatcacccatgtggtatagtgc

SEQ ID NO: 1206 - DNA, 3117 bp, synthetic construct
  misc_feature 1..3117: note = pXDP344 sequence
  source 1..3117: mol_type = other DNA
gccaccatgcccgcggccaaaagggtgaaattggacggagggaagcgcacggccgacggcagtgaattcgagtctccaaagaagaagcgcaaagttggtggcggctccggcggtggatctcccggctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggggggtagcccaaaaaagaagagaaaggtatga

SEQ ID NO: 1207 - DNA, 3174 bp, synthetic construct
  misc_feature 1..3174: note = pXDP350 sequence
  source 1..3174: mol_type = other DNA
gccaccatgctcgagcccgcggccaaaagggtgaaattggacggagggaagcgcacggccgacggcagtgaattcgagtctccaaagaagaagcgcaaagttgggggtagctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggccccaagcgaactgcagacagccagcactccacacctcctaaaaccaaacgcaaggtggagttcgagcctaagaaaaagcgcaaggtcgcggccgcctag

SEQ ID NO: 1208 - DNA, 3117 bp, synthetic construct; identical to SEQ ID NO: 1206
  misc_feature 1..3117: note = pXDP344 sequence
  source 1..3117: mol_type = other DNA

SEQ ID NO: 1209 - DNA, 3174 bp, synthetic construct; identical to SEQ ID NO: 1207
  misc_feature 1..3174: note = pXDP350 sequence
  source 1..3174: mol_type = other DNA

SEQ ID NO: 1210 - DNA, 4566 bp, synthetic construct
  misc_feature 1..4566: note = pXDP17 sequence
  source 1..4566: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgct

SEQ ID NO: 1211 - DNA, 14 bp, synthetic construct
  misc_feature 1..14: note = extended stem insert sequence
  source 1..14: mol_type = other DNA
ctagcggaggctag

SEQ ID NO: 1212 - DNA, 35 bp, synthetic construct
  misc_feature 1..35: note = extended stem insert sequence
  source 1..35: mol_type = other DNA
ctcggcttgctgaagcgcgcacggcaagaggcgag

SEQ ID NO: 1213 - DNA, 109 bp, synthetic construct
  misc_feature 1..109: note = extended stem insert sequence
  source 1..109: mol_type = other DNA
ctctctcgacgcaggactcggcttgctgaagcgcgcacggcaagaggcgaggggcggcgactggtgagtacgccaaaaattttgactagcggaggctagaaggagagag

SEQ ID NO: 1214 - DNA, 73 bp, synthetic construct
  misc_feature 1..73: note = extended stem insert sequence
  source 1..73: mol_type = other DNA
ggtgcccgtctgttgtgtcgagagacgccaaaaattttgactagcggaggctagaaggagagagatgggtgcc

SEQ ID NO: 1215 - DNA, 117 bp, synthetic construct
  misc_feature 1..117: note = scaffold sequence
  source 1..117: mol_type = other DNA
actggcgcttttatctgattactttgagagccatcaccagcgactatgtcgtagtgggtaaagctgcacctagcggaggctaggtgcagcatcaaagctgcattctagttgtggttt

SEQ ID NO: 1216 - DNA, 138 bp, synthetic construct
  misc_feature 1..138: note = scaffold sequence
  source 1..138: mol_type = other DNA
actggcgcttttatctgattactttgagagccatcaccagcgactatgtcgtagtgggtaaagctgcacctcggcttgctgaagcgcgcacggcaagaggcgaggtgcagcatcaaagctgcattctagttgtggttt

SEQ ID NO: 1217 - DNA, 212 bp, synthetic construct
  misc_feature 1..212: note = scaffold sequence
  source 1..212: mol_type = other DNA
actggcgcttttatctgattactttgagagccatcaccagcgactatgtcgtagtgggtaaagctgcacctctctcgacgcaggactcggcttgctgaagcgcgcacggcaagaggcgaggggcggcgactggtgagtacgccaaaaattttgactagcggaggctagaaggagagaggtgcagcatcaaagctgcattctagttgtggttt

SEQ ID NO: 1218 - DNA, 176 bp, synthetic construct
  misc_feature 1..176: note = scaffold sequence
  source 1..176: mol_type = other DNA
actggcgcttttatctgattactttgagagccatcaccagcgactatgtcgtagtgggtaaagctgcacggtgcccgtctgttgtgtcgagagacgccaaaaattttgactagcggaggctagaaggagagagatgggtgccgtgcagcatcaaagctgcattctagttgtggttt

SEQ ID NO: 1219 - DNA, 116 bp, synthetic construct
  misc_feature 1..116: note = scaffold sequence
  source 1..116: mol_type = other DNA
actggcgcttttatctgattactttgagagccatcaccagcgactatgtcgtagtgggtaaagctgcacatggagaggagatgtgcagcatcaaagctgcattctagttgtggttt

SEQ ID NO: 1220 - DNA, 111 bp, synthetic construct
  misc_feature 1..111: note = scaffold sequence
  source 1..111: mol_type = other DNA
actggcgcttttatctgattactttgagagccatcaccagcgactatgtcgtagtgggtaaagctgcacatggagatgtgcagcatcaaagctgcattctagttgtggttt

SEQ ID NO: 1221 - DNA, 14 bp, synthetic construct
  misc_feature 1..14: note = hairpin sequence
  source 1..14: mol_type = other DNA
ctagcggaggctag

SEQ ID NO: 1222 - DNA, 35 bp, synthetic construct; identical to SEQ ID NO: 1212
  misc_feature 1..35: note = hairpin sequence
  source 1..35: mol_type = other DNA

SEQ ID NO: 1223 - DNA, 109 bp, synthetic construct; identical to SEQ ID NO: 1213
  misc_feature 1..109: note = hairpin sequence
  source 1..109: mol_type = other DNA

SEQ ID NO: 1224 - DNA, 73 bp, synthetic construct; identical to SEQ ID NO: 1214
  misc_feature 1..73: note = hairpin sequence
  source 1..73: mol_type = other DNA

SEQ ID NO: 1225 - DNA, 13 bp, synthetic construct
  misc_feature 1..13: note = hairpin sequence
  source 1..13: mol_type = other DNA
atggagaggagat

SEQ ID NO: 1226 - DNA, 1902 bp, synthetic construct; identical to SEQ ID NO: 1140
  misc_feature 1..1902: note = pXDP164 sequence
  source 1..1902: mol_type = other DNA

SEQ ID NO: 1227 - DNA, 171 bp, synthetic construct
  misc_feature 1..171: note = sgRNA sequence
  source 1..171: mol_type = other DNA
actggcgcttttatctgattactttgagagccatcaccagcgactatgtcgtagtgggtaaagctgcactatgggcgcagcgtcaatgacgctgacggtacaggccacatggcagtcgtaacgacgcgggtggtatagtgcagcatcaaagcgagacgtaattacgtctcg

SEQ ID NO: 1228 - DNA, 179 bp, synthetic construct
  misc_feature 1..179: note = sgRNA sequence
  source 1..179: mol_type = other DNA
actggcgcttttatctgattactttgagagccatcaccagcgactatgtcgtagtgggtaaagctgcactatgggcgcagacatggcagtcgtaacgacgcgggtctgacggtacaggccacatgaggatcacccatgtggtatagtgcagcatcaaagcgagacgtaattacgtctcg

SEQ ID NO: 1229 - DNA, 171 bp, synthetic construct
  misc_feature 1..171: note = sgRNA sequence
  source 1..171: mol_type = other DNA
actggcgcttttatctgattactttgagagccatcaccagcgactatgtcgtagtgggtaaagctgcactatgggcgcagcgtcaatgacgctgacggtacaggccacatggcagtcgtaacgacgcgggtggtatagtgcagcatcaaagctgcattctagttgtggttt

SEQ ID NO: 1230 - DNA, 178 bp, synthetic construct
  misc_feature 1..178: note = sgRNA sequence
  source 1..178: mol_type = other DNA
ctggcgcttttatctgattactttgagagccatcaccagcgactatgtcgtagtgggtaaagctgcactatgggcgcagacatggcagtcgtaacgacgcgggtctgacggtacaggccacatgaggatcacccatgtggtatagtgcagcatcaaagctgcattctagttgtggttt

SEQ ID NO: 1231 - DNA, 4563 bp, synthetic construct; identical to SEQ ID NO: 1144
  misc_feature 1..4563: note = pXDP17 sequence
  source 1..4563: mol_type = other DNA

SEQ ID NO: 1232 - DNA, 2465 bp, synthetic construct; identical to SEQ ID NO: 1153
  misc_feature 1..2465: note = pSG17 sequence
  source 1..2465: mol_type = other DNA

SEQ ID NO: 1233 - DNA, 1533 bp, synthetic construct
  misc_feature 1..1533: note = pGP92 VSAV sequence
  source 1..1533: mol_type = other DNA
atgacccctgcctttatcctgtgcatgctgctggccggctcttcttgggccaaattcaccatcgtgttccctcagagccagaagggcgactggaaagacgtgcctcctaattaccggtactgccccagctctgccgaccagaactggcacggagatctgctgggcgtgaacatcagagccaagatgcctaaggtgcacaaggccatcaaggctgatggatggatgtgccacgccgctaaatgggtgaccacctgtgattatagatggtatggcccccagtacatcacacactccatccacagcttcatccccacaaaggcccagtgcgaggaatccatcaagcagaccaaggaaggtgtgtggatcaaccctggcttcccccccaagaattgcggatatgccagcgtgtccgacgccgagagcatcatcgtgcaggccaccgcccacagcgtgatgatcgacgagtacagcggcgattggctggacagccaatttcctacaggcagatgcaccggcagcacctgcgagacaatccacaacagcaccctgtggtacgccgattaccaggtgaccggcctgtgtgacagcgctctggtgtctacagaagtcacattctactcagaggacggcctgatgacaagcatcggaagacagaacaccggctacagaagcaactacttcccctacgagaagggagcagctgcttgtagaatgaaatactgtacccacgagggcattagactgcccagcggcgtgtggttcgagatggtcgacaaggagctgctggaaagcgtgcaaatgcccgagtgcccagccggactgacaatcagcgcccctacccagacatctgttgacgtcagcctgatcctggacgtggaacggatgctggattactccctgtgccaggagacatggtctaaggtgcatagcggcctgcctatcagccctgtggaccttggctacatcgctcctaagaaccctggcgccggccctgcttttaccatcgtgaacggcaccctgaagtacttcgacacaagatacctgagaatcgacatcgagggccctgtgctcaaaaagatgaccggcaaggtgtccggcacacctaccaagcgggaactgtggaccgagtggtttccatacgacgacgtggaaattggacctaacggcgtgctgaaaacccctgagggctacaagttcccactgtacatgatcggccacggcctgctcgattctgatctgcagaagacaagccaagccgaagtgttccaccacccccagatcgccgaggccgtgcagaagctgcctgacgatgaaaccctgttcttcggcgacaccggcatcagcaagaatccagtggaagtcatcgagggatggttcagtaactggcggagcagcgtgatggccattgtgtttgccatcctgctgcttgtgatcacggtgctgatggtgcggctgtgtgtggccttcaggcacttctgctgccagaaaagacataagatctacaacgacctggaaatgaaccagctgcgcaga

SEQ ID NO: 1234 - DNA, 1515 bp, synthetic construct
  misc_feature 1..1515: note = pGP99 ABVV sequence
  source 1..1515: mol_type = other DNA
atggtgagaatcatctgctggctgggcctggtgctgtctgtccaggccgccaaggtgattctgccagtgaaactggaaagcgactgggtccctgtgtacagcggagaaaggatctgccagagccacagagaaaagatccctcctggaatctacgagagcctcaaggtggaaggccaggtgcctgtgcggcagcagagccagggcgccgacggctactactgccacaagaccatctatagcgtgctgtgtgacttcaagtggtacggcgtgaagagagtgcggcacagcgtgaaaagagataccccttcttatagcgagtgcctgaaggctgtggacgatgagattagcggcatgtctgagtacgtgggctttcctccaccatcttgcaactacctggtggaaaccagaagccagaacatcgagatcatcctgagcaagcactccgtgaagatcgacgactacaagcagagctggatggacagcaccttcctggacggcggatgttcacacgccccttgtctgaccaccgtgccaggcacactgtggatccccacagataacctgacaagcgcctgcgacatcacatttcggaagcaggagttcaccatctattaccctaagcaaaaacctgctcacctgtccagcgaccagatctttatcaccagcccctaccaccccgtgtccagcctgagcaagtcctgcctgattacactgtgcggcaaaaccggcatcagactgcctggaggcagttggtcaagcctggacaaccacaagtccttccacgacatcaagatcgagacactgctgagcaactgcaagagctctaccgagatctacagcagcccccccgatctgcggaacatcagaatggtctgggatctggagagagtgatcgagaacagcctgtgtcagggaacatgggacaagatcgaaacacggcagaagatcacccctctggatctgaattacctgtctcctagcgagcctggtcctggctggggcttcatccccaagaacggcagcatccacaaagcccaaatcctgtacatcagagccgatgtggacgacgacaccatcgccctgggccagaaatacaacaagggcaaggacgagttctacttcaactggaatgactgggaactgctgaatggcatcaagatcggccccaacggaatcatcaccaacacacacgtgcggatcccttactacagcgtgggaatcggaaaactggacgaagatatgatcacccctgatgaggtgggcgtgatccaccacatcgaccacctgaagcaaagagtgcttgtgcagaccaatctggatagagtctggatccacgagggcgaaaacggcgacctgatcactagcgtttctcattggtggcatgatgtgattaagcactcttgggagatcttcgccctgattggcggcctgttcagcctgtcttgtatctgcagcctgtgcagctgccggaagaaacgtagagagagcagacaccaggagaccatgagcttcgtg

SEQ ID NO: 1235 - DNA, 1569 bp, synthetic construct
  misc_feature 1..1569: note = pGP98 CARV sequence
  source 1..1569: mol_type = other DNA
atgaaaatgaagatggtgatcgccggcctgatcctttgtatcggcatcctgcctgctatcggaaaaatcaccatcagcttccctcaaagcctgaagggagattggcggcctgtccccaagggctacaactactgccccacaagcgccgataagaacctgcacggcgacctgattgacatcggcctgagactgcgggcccctaaatccttcaagggcataagcgccgacggctggatgtgccacgccgctagatggatcaccacatgcgattttagatggtacggccctaagtacatcacacacagcatccattccttcagacctagcaacgaccagtgcaaagaggccatcagactgacaaacgagggcaactggatcaatcctggctttcccccccagtcttgtggctacgcctctgtgacagacagcgagagcgtggtggtgaccgtgaccaagcaccaggtcctcgtggacgagtactctggatcctggatcgacagccagttccctggcggcagctgcaccagccccatctgtgacaccgtgcacaactctaccctgtggcacgccgatcacaccctggatagcatttgcgaccaggagttcgtggccatggacgccgtgctgttcacggaaagcggcaagttcgaggagttcggcaagcccaacagcggcatccggagcaactacttcccatacgagagcctgaaggacgtgtgccagatggatttctgcaagcggaagggctttaagctgccaagcggcgtgtggtttgagatcgaggacgccgagaagagccacaaggcccaggtggagctgaagatcaagcggtgccctcatggcgccgtgatcagcgctcctaaccagaatgccgccgacatcaacctgatcatggacgttgagaggatcctggactacagcctgtgtcaggccacctggtccaagatccagaacaaggaagctctgacacccatcgacatcagctacctgggccctaagaaccctggacccggccctgcctttaccatcatcaacggcaccctgcactacttcaacaccagatacatcagagtggatattgccggcccagtgaccaaggaaatcaccggcttcgtgtccggaacaagcaccagtagagtgctgtgggaccaatggttcccttatggcgagaactctatcggccctaatggcctgctgaagaccgccagcggctacaagtatcctctgttcatggtgggcaccggcgttctggacgctgacatccacaagctgggagaagccacagtgatcgagcacccccacgccaaggaggctcagaaagtggtcgacgactcagaggtgatcttcttcggggataccggagtgtctaagaatcctgtggaagtggtggaaggttggttcagcggctggagaagctctctgatgagcatcttcggaattatcctgctgatcgtgtgtctggtgctgatcgtgcggatcctcatcgccctgaaatactgctgcgtgcgccacaaaaaaaggacaatctacaaagaagatctggaaatgggcagaatccccagaagagcc

SEQ ID NO: 1236 - DNA, 1590 bp, synthetic construct
  misc_feature 1..1590: note = pGP97 CHPV sequence
  source 1..1590: mol_type = other DNA
atgacaagctctgtgaccatcagcgtgatcctgctcatctctttcatcgccccttcttattccagcctgtccatcgccttccctgagaacacaaaactggactggaagcctgtgaccaagaatacccggtactgtcctatgggcggagagtggttcctggaacccggcctgcaggaggaaagcttcctgagcagcacccctatcggagccacccctagcaagagcgacggcttcctgtgccacgccgccaagtgggtgacaacctgtgacttcagatggtacggacctaagtacatcacacacagtatccacaacatcaagcccaccagatctgattgcgacactgccctggccagctataagtctggcaccctggtgtcccctggatttcctcccgagagctgcggctacgccagcgtgactgattcagagttcctggtgatcatgatcaccccacaccacgtgggcgtggacgattacagaggccactgggttgatcctcttttcgtgggcggcgagtgcgaccagagctactgcgacacaatccataatagcagcgtgtggatccccgctgatcagaccaaaaaaaacatctgcggccagtcttttacccctctgacagttaccgtggcctacgacaagaccaaggagatcgccgctggcgctatcgtctttaaatctaagtaccacagccacatggagggcgctcgcacctgcagactgtcctactgcggcagaaacggcatcaagttcccaaacggagaatgggtctccctggacgtgaagacaaagatccaagagaagccactcctgccgctgttcaaagaatgccccgccggcacagaggtgcggagcacactgcaaagcgacggcgcccaggtgctgaccagcgaaatccagagaatcctggactacagcctgtgtcagaacacctgggacaaggtggagaggaaggaacctctgtctccactggatctgagctacctggccagcaagagccctggcaagggcctggcttacaccgtgatcaacggtaccctgagcttcgcccacacaagatacgtgcggatgtggatcgacggccccgtgctgaaggaaatgaaaggcaaaagagagtcccctagcggcatcagcagcgacatctggacccagtggttcaagtacggggatatggaaattggccctaacggcctgcttaagaccgccggaggatataagttcccttggcatctgatcggcatgggcatcgtggacaacgagctgcacgagctgtctgaggccaaccccctggatcacccccagctgcctcacgcccagtccatcgccgacgacagcgaggaaattttcttcggcgataccggcgtgagcaaaaatcctgtggagctggtgacaggatggtttaccagctggaaggaatccctggctgccggcgtggtgctgatcctggtggtcgtcctgatctacggcgtgctgcggtgcttccccgtgctctgcaccacctgtagaaagcccaagtggaaaaagggcgtggagcggagcgacagctttgagatgcggatcttcaagccgaacaacatgagagccagagtg

SEQ ID NO: 1237 - DNA, 1536 bp, synthetic construct
  misc_feature 1..1536: note = pGP100 COCV sequence
  source 1..1536: mol_type = other DNA
atgaacttcctgctgctgacctttatcgtgctgcctctgtgtagccacgccaagttcagcatcgtgtttcctcagtctcagaagggcaactggaagaacgtgcctagcagctaccactactgtcctagcagctccgatcagaattggcacaacgacctgctgggcatcaccatgaaagtgaagatgcctaagacccacaaggccattcaggccgacggctggatgtgccacgctgctaaatggatcacaacatgcgacttccggtggtacggccccaagtacatcacccatagcatccacagcatccagcccacaagcgagcagtgtaaagagagcattaagcaaaccaagcagggcacatggatgagccctggattccctccacagaactgtggctacgctaccgtgactgatagcgttgccgtggtcgtgcaggccacacctcatcacgtgctggtggacgagtacaccggcgagtggatcgacagccaatttcctaacggcaagtgcgaaaccgaggaatgcgagacagtgcacaacagcaccgtgtggtattccgattataaggtcaccggcctgtgcgacgccacgctggtcgacaccgaaatcaccttcttctctgaagatggcaaaaaggaaagcatcggcaagccaaacaccggataccggtctaattactttgcctacgagaagggcgacaaggtgtgcaagatgaactactgcaagcacgccggcgttagactgccatcaggcgtgtggttcgagttcgtggaccaggacgtgtacgccgccgccaagctgccagagtgccccgtgggcgccacaatcagcgcccccacccagacatctgtggatgtgtctctgatcctggacgtggaaagaatcctggattactctctgtgccaggagacatggtccaagatcagaagcaaacagcctgtgtcccctgtggacctgagctacctggctcctaagaaccctggcaccggacctgccttcaccatcatcaacggaaccctgaaatacttcgagaccagatacatccggatcgacatcgacaaccccatcatttctaagatggtcggaaagatcagcggaagccagaccgagagagagctgtggacagaatggttcccctacgagggcgtggaaatcggacctaatggcatcctgaaaacccctaccgggtacaagttccccctgttcatgatcggccacggcatgctggactctgacctgcacaagacctcccaagctgaagtgttcgagcacccccacctggccgaggcccctaaacagctgcccgaggaggaaaccctgtttttcggcgatacaggcatctccaagaatcctgtggaactgatcgaaggctggttcagcagctggaagagcaccgtggtgacatttttcttcgccatcggcgtattcatcctgctctacgtggtggccagaatcgtgatagctgtgcggtacagatatcagggcagcaacaacaagcggatctacaacgatatcgagatgagcagattcaggaag

SEQ ID NO: 1238 - DNA, 1533 bp, synthetic construct
  misc_feature 1..1533: note = pGP91 VSIV sequence
  source 1..1533: mol_type = other DNA
atgaagtgtctgctgtacttggcttttctgtctatcggcgtgaactgcaaattcacaatcgtgttccctcataaccagaaaggcacctggaagaacgtgcctagcaactaccactactgtcctagctcttccgacctgaactggcacaacgacctgatcggcaccgccctgcaggtcaagatgcctaagagccacaaggccatccaagctgatggctggatgtgccacgcctctaagtgggtcacaacctgcgacttcagatggtacggccctaagtacatcacccactctatcagaagctttacaccatctgtggaacaatgcagagagagcatcgagcagaccaagcagggcacatggctgaatcctggcttcccacctcagagctgcggctacgccaccgtgaccgatgccgaggccgtgatcgtgcaggtgacccctcaccacgtgctggtggacgagtacaccggggagtgggtggacagccagttcatcaatggcaagtgcagcaatgacatctgccccaccgtgcacaacagcaccacatggcatagcgattacaaggtgaagggcctgtgtgacagtaacctgatttctatggacatcaccttcttcagcgaggacggagaactgagcagcctgggcaaggaaggcacaggatttcggagcaatcacttcgcctacgagacaggagataaggcctgcaagatgcagtactgtaagcactggggcgtgcggctgcctagcggcgtgtggttcgagatggccgaccaggacctgttcgccgctgctagattccctgagtgccccgagggcagcagcattagcgcccctagccaaacaagcgtggacgtgtctctgatccaggatgtggaaagaatcctggactactccctctgccaggagacatggagcaagatcggcgccggcctccccatcagccctgtggatctgtcctacctggcccctaaaaacccagggacaggccccgccttcaccatcattaacggcaccctgaaatacttcgaaaccagatacatccgggtggacatcgccgctcctatcctgtcaagaatggtgggcatgatcagcggaacaaccaccgagcgggaactgtgggatgactgggccccttacgaggatgtggaaatcggacccaacggagttctgcgcacgtcctccggatataagttccccctgtatatgatcggccacggcatgctggattccgatctgcacctgtcctctaaagcccaggtctttgaacacccccacatccaggacgccgcatctcagctgccagacgacgaaaccctgtttttcggcgacaccggcctgtctaagaaccccatcgagctggtggaaggctggtttagcggctggaagagcagcatcgccagcttcttcttcatcatcggactgatcatcggcctgttccttgtgctgagagtgggcatctatctgtgcatcaagctgaaacacaccaagaagcggcagatctacaccgacatcgagatgaacagactgggcaaa

SEQ ID NO: 1239 - DNA, 1569 bp, synthetic construct
  misc_feature 1..1569: note = pGP90 ISFV sequence
  source 1..1569: mol_type = other DNA
atgaccagcgtgctgttcatggtgggcgtgctgctcggcgccttcggctctacccactgcagcatccagatcgtctttcccagcgagacaaagctggtctggaaacctgtgctgaagggcaccagatactgtccccagagcgctgaactgaacctggaacccgacctgaagaccatggccttcgactctaaggtgcctatcggcatcacacctagcaattctgatggctacctgtgccacgccgccaagtgggtcaccacatgcgacttccggtggtacggccctaagtacatcacccacagcgtgcacagcctgagacctacagtgtccgattgcaaggccgccgtggaagcctacaacgccggaacactgatgtaccctggcttcccacctgagagctgcggctatgcctcaatcactgacagcgagttctacgtgatgctggtgacccctcaccccgtgggcgttgacgactacagaggccactgggtggatcctctcttccccaccagcgagtgcaattctaacttctgcgagacagtgcacaacgccacgatgtggattcctaaggacctgaagacacacgacgtgtgcagccaagatttccagaccatccgggtgagcgtcatgtacccccagaccaagcccaccaagggggccgacctgaccctgaagagcaagttccacgcccatatgaagggagatagagtgtgtaaaatgaagttctgcaacaagaacggcctgcggctgggcaacggcgaatggatcgaggtgggcgatgaggtgatgctggacaacagcaaactgctgtctctgttccctgactgcctggtgggatctgtggtgaagagcacactgctaagcgagggcgtgcagaccgccctgtgggagacagatagactgctggattacagcctgtgtcagaacacctgggaaaagatcgaccggaaggagcctctgagtgctgtggacctgtcctacctggcccctaggagcccaggcaagggcatggcctatatcgtggccaacggcagcctgatgtccgccccagcgagatacatcagagtgtggatcgacagccctattctgaaagagatcaagggcaaaaaggaaagcgcaagcggcatcgacaccgtgctctgggagcagtggctgcctttcaacggaatggaactgggacctaacggcctgatcaagacaaagtctggctacaagtttccactgtacctgttgggaatgggcatcgttgatcaggacctgcaggagctgagcagcgtcaaccccgtggaccaccctcatgtgcccatcgcccaggcctttgtgagcgagggcgaggaagtgttcttcggagacaccggcgtgtctaagaatcctatcgagctgatttccggatggttcagcgactggaaggaaaccgccgctgctctgggttttgccgccatctccgtgatcctgatcatcggcctgatgagactgctgcctctgctgtgtcggcggcgcaagcaaaagaaagtgatctacaaagacgtcgaactgaacagcttcgaccccagacaggcttttcacaga

SEQ ID NO: 1240 - DNA, 1572 bp, synthetic construct
  misc_feature 1..1572: note = pGP87 JURV sequence
  source 1..1572: mol_type = other DNA
atggaatctctgcctttttctgccctgctggccgtgcttagcatcaccctatgcgacagcgctatccctatcttcttcccttctgagcctcagctggaatggaaacctgtgctgcccggcagcagatactgccctcagagcaacgagatgagcctggatcctgatctgaagaagtccacaatttctgtgaaggtgcctatcggcgtgacccctagcaagagcgacggctacctgtgccacggcgctaaatgggtgtccacctgcgatttcagatggtacggccctaagtacatcacccacagcatccacaatctgagacctaccacaaacgactgcgaggacgccatcaagaaatacgaggccggcacactgatcaaccctggcttcccacctgacagctgcgcctacgccacagtgactgattctgagcacctggtcatcctgatcacccctcaccacgtgggagtggacgattacagaggcgcctgggtcgacgacagcttcccttccggcgtttgtgaaacaaaccaatgtgataccacccacaacagcagcatctggatccccaagaccaagacaagacacaacatctgttctcagaccttcgccaacctgagcgtgaccatcagctaccgggaaggaggcgccatgaaaggcgccgatatggttttccacagcaagtaccaccctcatatggtcggcggccacatctgtaaaatgaacttctgcaacaagcagggcctgcggctgcagaacgaggaatggatcgagattcccagcggaacaaaggtgggcaaccaggacctgatgaacctgttcagcgattgcaagagcggcctggaggtgcggtctaccctgcgcagcgagggcgccaataccctgacctgggagacacagagactgctcgattatgccctgtgtcagaacacatgggacaagttcgacaaccagggcgctgtgtccgccctggacctgagctacctggctgctagagcacctggaaagggcgtggcttacaccatgatcaatggcaccctccacagcgcccctacgaggtacgtgcggatgtggatcgagagtccttctatggaagagctgaaagccaagaaggagagcagcagcggagtggaaaccagcatctggaaccagtggttcccattcaagggcggagagatcggaccaaatggcctgatcaaggccggcaataaatacaagttccccctgtacctggtgggcatgggcatgctggacgacgagatcaacgccctggaactgggaggtcccatcgaccacccccaaagagcccacgcccaggccgtgctgggcgatgaggaaacactgtttttcggcgacaccggcgtgggcaagaaccccgtggaactgattacaggctggtttagcggctggaaggagacaatcatggccgtggtggccatctttctgctggtgatcgtgctgtatggcgtgctgagatgctgccccaccatctgcgtgctgtgcaagagaaagagcagacatagaaccaaggacatggaaatgcagtacatccccaacaaccagcggcactggcgg

SEQ ID NO: 1241 - DNA, 1563 bp, synthetic construct
  misc_feature 1..1563: note = pGP89 MSPV sequence
  source 1..1563: mol_type = other DNA
atggaaagcctgctgaaagccatctgcgtgctgctgctgatccactgcagcagatgcgacctgcctatcgtctttcctgaccagaaggagctgctgtggaaccccgtgctgaagacaaatagatactgcccccagacaagagagatcgctcctctggataagcccaagaccctgaagatcaccacaggagttccagttagaagcccgaaggaaaagatcgaaggctacctgtgtcactctggcaagtgggtgaccacctgtgattacagatggtacggcgctaagtatgtgacccacagtatccaccacctgaaacctaccgatcagatgtgcagagacgccatcagccaatacaacggcggcacactgctcaaccctggctttccccccgaggtgtgtggctatgcttctgtgaccgacagcgagcttatcatcaccctgatcacacctcacaccgtgggcgtcgacgactaccggggactttggatcgaccctagcttcccaaacggcgagtgcaacagcatcgtgtgcgagacaatccataatagcaccaagtgggtctccaagggcgagatgcctacagacatctgtcagcagaccttcaccaccatcaagatggatgtgtcttatccatctgatacaacgtcccagggcagcctgctgtcttttcacagcccttaccacccccacatcagcggcaaggacatctgcaagatgagctactgtggcagcaacggcctgagactgcccaacggcgaatggttcagcatcattaacaccagcaagatcggcaacaagaacctgatcgacttcttcagcccttgcaaggccggcgtggaagtgcggagcaccctgcagagcgagggctcccagacaatcgcctgggaaacccagagaatgctggactacgccctgtgccagaatacctgggacaagttcgagaggggcgagcctctgtcacccctggacctgaactacctggcccctcgggtgcccggcaaaggcatggcctacaccatcatcaacaacaccctgcactctagccacgccgtgtaccgcagagtgtggatcgagggccctatcataggcgagatgaaaggaaagatcgagagcgccacaggcgtggccaaggaaatttgggcccagtggtttgagttcggccagaacaagatcggacctaatggagtgatcaagaccaacgacggcatcaagttccctctgtacgctattggcaccggcctgatcgaccaggacatccacgagctgtccgaggtgtcccccatggaccaccctcatctggtgcacgccaaaaaatacgtgtctgaagatgatgagatctacttcggcgacaccggagtgtcccacaatcctgtggaaatcttcagcggatggttcaccaactggaaggagggactgatgaaattctctatcctggtgctgagcatcctgattttctacgtggtgatcagactggtcatgtgcatccctctgaagtgcaagaaggaaagaaagccacggctggagttcgagctgcaacctcgggaatgggagtacagccgggcc

SEQ ID NO: 1242 - DNA, 1536 bp, synthetic construct
  misc_feature 1..1536: note = pGP88 MARV sequence
  source 1..1536: mol_type = other DNA
atgctgagactcttcctgttctgcttcctggccctgggagcccacagcaagttcaccattgtgttccctcatcaccagaaaggcaattggaaaaacgtgcccagcacctaccactactgtcctagctctagcgaccagaactggcataatgacctgaccggcgtgtccctgcacgtgaaaatccctaagagccacaaggccatccaagccgacggctggatgtgccacgcagctaagtgggtgaccacatgcgacttcagatggtacggcccaaagtacatcacccactctatccacagcatgtctcctaccctggaacaatgtaaaacatctatcgagcagaccaagcagggcgtgtggatcaaccctggatttccacctcagagctgcggctacgccacagtgacagatgccgaggtggtcgtggtgcaggccacccctcaccacgtgctggtggatgagtacaccggcgagtggatcgacagccaactggtgggcggcaagtgcagcaaggaagtgtgccagaccgtgcacaacagcaccgtgtggcacgccgattataagatcaccggcctgtgcgagtctaacctggccagcgtggacatcacatttttcagcgaggatggccagaagaccagcctgggcaaacctaacaccggattccggtccaaccacttcgcctatgagagcggagagaaggcctgtagaatgcagtactgcacccagtggggcatccggctgcctagtggagtgtggttcgagctcgtggacaaggacctgtttcaggctgctaagctgcccgagtgccccagaggcagcagcatctccgccccaagccagacaagcgtggacgtcagcctgatccaggacgtcgaacggatcctggactacagcctgtgtcaggagacctggtccaagatccgggccaagctgcctgtgtcccctgtggaccttagctacctggctcctaagaatcccggcagcggccccgccttcaccatcatcaacggcaccctgaagtacttcgagaccagatacatcagggtggatatcagcaaccccatcatcccgcacatggtcggtaccatgtctggaacaacaacagagcgggaactgtggaacgactggtacccttatgaagatgtggaaatcggacctaatggcgtgctgaaaacacccaccggctttaagttccccctgtacatgatcggccacggcatgctggatagcgatctgcataagagctcccaggcccaggtgttcgagcaccctcacgccaaagacgccgcttctcaactgcctgacgacgagacactgttcttcggcgacaccggcctgagcaagaacccagtggaactggttgaaggctggttctcaagctggaagtctaccctggcctcttttttcctgatcataggactgggcgtggctctgatcttcatcattagaatcatcgtggccatcagatacaagtacaagggcagaaagacacagaagatctacaacgatgtggaaatgagcagactgggcaacaag

SEQ ID NO: 1243 - DNA, 1539 bp, synthetic construct
  misc_feature 1..1539: note = pGP100 MORV sequence
  source 1..1539: mol_type = other DNA
atgctggtgctgtacctcctgctgagcctgctggccctgggcgcccagtgcaagttcaccatcgtgttccctcacaaccagaagggcaactggaagaacgtgcccgctaattaccagtactgtcctagctcttctgacctgaattggcataatggcctgatcggaaccagcctgcaggtgaaaatgcctaaaagccacaaggccatccaggccgatggatggatgtgccacgccgctaagtgggtcacaacctgtgatttcagatggtacggccctaagtacgtgacccacagcattaagtccatgatccctaccgtggaccagtgcaaggaaagcatcgcccagaccaagcagggcacatggctgaaccctggctttccaccacagagctgcggctacgccagcgtgaccgacgccgaggccgtgattgtgaaagccacacctcaccaggtgctggtggatgagtacacaggagaatgggtggatagccagttccctaccggaaaatgcaacaaagacatctgccctacagtgcacaacagcaccacatggcacagcgactacaaggtgacaggcctgtgcgacgccaatctgatctctatggacatcaccttcttcagcgaggatggcaagctgaccagcctgggaaaggaaggcaccggcttccggagcaactacttcgcctacgagaacggcgataaggcttgtagaatgcagtactgcaagcactggggcgtgcggctgccttctggcgtgtggttcgagatggccgataaggacatctacaacgacgccaagttccccgactgccccgagggcagcagcatcgccgcccctagccaaacatctgtggacgtgtccctgatccaggacgtggaacggatcctggattacagcctgtgccaggagacctggtccaagatcagggcccacctgcccatctcccctgtggacctgtcctacctgtctcctaaaaaccccggcaccggccctgcttttaccatcattaacggcaccctgaagtacttcgagacaagatacatccgggtcgacatcgccggccccattatcccccagatgagaggcgtgatcagcggcaccacaaccgagcgggaactgtggaccgattggtacccctacgaggacgtggaaatcggccctaacggcgtcctgaagaccgccaccggatataagtttcctctgtatatgatcggccacggcatgctggacagcgatctgcacatcagcagcaaggctcaagtctttgagcaccctcatatccaagacgccgctagtcagctgcctgacgacgagacactgttcttcggcgacaccggcctgtctaaaaacccaatcgagctggttgaaggatggttcagcggatggaaaagcacaatcgcctcttttttcttcatcatcggactggtgatcggcctgtacctcgtgctgagaatcggcatcgccctgtgtatcaagtgcagagtgcaggagaagagaccaaagatctatacagacgtggaaatgaacagactggataga

SEQ ID NO: 1244 - DNA, 1551 bp, synthetic construct
  misc_feature 1..1551: note = pGP84 VSNJV sequence
  source 1..1551: mol_type = other DNA
atgctgagctacctgattttcgccctggtggtgtcccctatcctgggcaagatcgaaatcgttttcccccagcacaccaccggcgattggaagcgggtgcctcacgagtacaactactgtcccacgagcgctgataagaacagtcacggcacacagaccggcatccctgtggagctgaccatgcctaagggactgacaacccatcaggtggatggctttatgtgccacagcgccctgtggatgaccacatgcgatttccggtggtacggccctaagtacatcacacacagcatccacaacgaggaaccaaccgactaccagtgcctggaggctatcaaggcctacaaggacggcgtgtccttcaaccccggcttcccacctcaaagctgcggctacggcaccgtgacagatgccgaggctcacatcgtgaccgtgacaccccacagcgtgaaggtggacgagtataccggcgaatggatagacccccacttcatcggcggcagatgtaaaggccagatctgcgagacagtgcacaacagcacaaagtggttcacctccagtgacggcgagagcgtgtgctctcagctgttcaccctggtgggaggaaccttcttcagcgacagcgaggagatcaccagcatgggcctccctgagaccggcattagaagcaactactttccttacgtctccacagagggcatctgtaaaatgcccttctgtagaaagcctggatacaaactgaaaaatgacctgtggtttcagatcaccgatcctgacctggacaagaccgtgcgcgacctgccacacatcaaggactgcgacctgagcagctccatcgtgacccctggtgaacacgccacagatatcagcctgatctctgacgtggaacggatcctggattacgccctgtgccagaacacctggagcaaaatcgaggctggcgagcctatcacccctgtggacctctcttatctgggaccaaagaatcccggcgccggccccgtgttcaccatcatcaacggatctctgcactacttcatgagcaagtacctgagagtggaactggaaagccctgtgatcccgagaatggaaggaaaagtggccggcacaagaattgttcggcaactgtgggaccagtggttccctttcggcgaagtggagatcggccctaatggcgtgctgaagaccaagcagggctacaagttccccctgcacatcatcggcaccggcgaggtcgacaacgacatcaagatggaaagaatcgtgaagcactgggagcaccctcatatcgaggccgcccagacattcctgaagaaagacgacaccgaggaagtgctgtactacggagatactggcgtgtctaagaaccctgtggagctggtcgagggctggttctctggctggcggagcagcatcatgggcgtgctggccgtgatcatcggatttgtgatcctgatcttcctgatcagactgattggcgttctcagctctctgtttagacagaagaggcggcctatctacaagagcgacgtggaaatggcccatttcaga

SEQ ID NO: 1245 - DNA, 1575 bp, synthetic construct
  misc_feature 1..1575: note = pGP85 PERV sequence
  source 1..1575: mol_type = other DNA
atgagcagcaagatcgtgctggctgctatctgcctgtgcagcgtgcagtacgtggcatgcagcttccagatcgtgttccccgagttcaacaacgccgcctggctgccttacctgaaaacaagcagatactgtcctcagagcgccgagatggagttcgagagaagagtgagcaccacgctgctgtccgccgacgtgcctatcggcgtgacccctaccaagagcgacgggtatctgtgccacgccgccaagtgggtgacaacctgtgatttccggtggtacggccctaagtacgtgacccactctatccacgacctgacccctgcccaagtggactgccacgaggccctggccagatacaaggccggcaccctgttcaacccaggattcccccccgctagctgcggctacgccacaatcacagacagcgaacagaaggttgtgatgatcaccccgcaccacgtgggcatcgacgactaccggggcaagtggatcgaccctatttttcctggaggcgagtgcaccaccaactactgcgagaccctgcataatagcagcgtttggctgcctgccgatgagaaaatcgtggacatctgtgcccaaaccttcagaaagattaaggtgaccgccacctaccccagcgaaggcgcggtgacaaaggaaaccatcagcctgcatagcgcttaccaccctcacgtgccaggcactggaatttgtagaatgacctactgcagcaaggagggcctcagactgccaaatggcgaatggctgggcatcttctacgacaaccggatcaaaacaaccgacgtgcggaccgtgttccctgcctgccctgacggcctggaagtgaagtccacactgaactctgatggagctaataccatcgcctgggagacacagcggatgctggactacgccctgtgtcagtctacatgggacaaggtgcagaacaaggaaccactgtccgccgtggatctgagctacctgtctgcccggagccctggcaagggactggcctacaccgtgatcaacggcaccctgcactttgcccacgttagatatgtgcgcacctggatcgacggcccagtgctgaaagacctgaagggcagcagattcgatcccacagccgctcagaaaaccctgtgggaccagtggttccctttcggcagcaacgagatcggccctaacggccttctcaagacccccaaggacttcaagttccctctgtacatcatcggaaccggcctggtggacgaagatctgcaagagctgtctgaagccggtcccatcgaccacccccagatccccgacgccagcggcatcctgcccaactctgagcaggtctactacggagataccggcgtctccaagaaccccatcgagctgatcgagggctggtttgccaactggaaggaaaccgtgatgagcatcgtgggcctggtgctcctgatcaccatcgtgtttacagtcctgaagtgcatcggcacatgcagaagcctgaggcggaaaagaaagatcgagaaggacatcgagctgcaggagatcggcccttaccagcctacaacatatagacctaga

SEQ ID NO: 1246 - DNA, 1587 bp, synthetic construct
  misc_feature 1..1587: note = pGP94 PIRYV sequence
  source 1..1587: mol_type = other DNA
atggacctgttccccatcctggtggtcgtgctgatgaccgataccgtcctcggcaagttccagatcgtgttccccgaccagaatgagctggaatggcggcctgtggtgggcgactccagacactgcccccaaagcagcgagatgcagttcgacggcagccggagccagaccatcctgaccggcaaggcccctgtgggcatcacccctagcaagtccgacggcttcatctgtcacgcagctaaatgggttacaacatgtgatttcagatggtacggccccaagtacatcacccactcaatccaccatctgagacccaccacctccgattgcgagacagccctgcagcggtacaaggacggcagcctgattaacctgggctttccacctgagagctgcggctacgccaccgtgactgattctgaagcgatgctggtccaggtgacccctcaccacgtgggagtggacgactatagaggccactggatcgaccccctcttcccaggaggcgagtgcagcaccaacttctgcgacaccgtgcacaacagctccgtgtggatccctaagtctcagaaaacagacatctgcgcccagagcttcaagaacatcaagatgaccgccagctatcctagcgagggggccctggtgagcgatagattcgccttccactctgcctaccaccctaacatgcccggaagcactgtgtgcatcatggacttttgtgaacagaagggcctgcgcttcaccaatggcgagtggatgggactgaacgtggaacagtctattagagagaagaagatcagcgccatctttccaaattgcgtggccggcacagagatcagagccacactggaaagcgaaggcgctagaaccctgacatgggagacacagcgcatgctggactacagcctttgtcagaacacctgggacaaggtgtcccggaaggaacctctgagccctctggacctttcttacctgtctccaagagcccctggcaaaggcatggcctacaccgtgatcaacggcaccctgcattccgcccacgccaagtacatccggacctggatcgactacggcgagatgaaagaaatcaagggcggcagaggagaatacagcaaggcccctgagctgctgtggagccaatggtttgatttcggccccttcaaaatcggccctaatggactgctgcacaccggaaagacattcaagttccccctgtacctgattggagctggcatcatcgacgaggacctgcacgagctggatgaggccgctcctatcgaccacccccaaatgcctgatgccaaaagcgtcctgcctgaagatgaagagatcttcttcggcgatacaggcgtgtctaagaaccctatcgagctgattcagggctggtttagcaactggcgggaaagcgtgatggccatcgtgggcatcgtgctgctgatcgtggtgacatttctggccatcaagaccgtgcgggtgctgaactgcctgtggagacctagaaagaaaagaatcgttagacaggaggtggacgtggaatctcggctgaaccacttcgagatgaggggcttccctgagtacgtgaagaga

SEQ ID NO: 1247 - DNA, 1668 bp, synthetic construct
  misc_feature 1..1668: note = pGP96 RADV sequence
  source 1..1668: mol_type = other DNA
atgatctctatcaccttcgtgtacctgattatcatcctgagcctgagctggggagagatgatgatccctttccccgacgtgaccacaactacatggaagcctgtgctgaagggcgagcaccactgcccttctagcagcgacgttgatatcctgagcagaatgagcacactcaagctgcaggtgagaatccccaccggcagcgtggccagcaagagcgacggcctgctgtgtcacggcgcaaagtgggtgacaacatgcgacttccggtggtacggcagcaagtacatcacacacagcctgcacagcatccggcctaccctgtcccagtgcaccgaggccgctaaagcctataaggagggaagactcatggcccctggcttcccccccgagtcatgcggctggaatagcgtcacagatagcgagctgctgagcatcctggtcacccctcaccataccggcgtggacgattacagaggcatctggatcgactctatgttccctggaggcgagtgcaaggaaatggtgtgcgacaccgtgcaaggacacaccatctggatgagcacatctaatctgaccaccgcctgcggcgtggccttcaagcagatccagggccagttctactacctgaactctggccaccagcctaacaaagagggcaccttcttccactctcccaaccaccccaatagccctctgagcaccgcctgtagaaagaaatactgcaaccaggagggcatcgtgatccacacaggagaatggatcggcgttccttggaacacaagaatcagagatgtgcagctggactcttataccgacctgtgcgccgagagtacagaaataaagtctaccattgggagcgctcctatccgggtgatcgcctgggagatggaaagagttatggacttcgccctgtgtcagacagtgtgggacaaggtgaacagaggcgacccactgagcccactggatctgagctacctgagctctagggctcctgggaagggcctggcctacaccatcatcaatgaaaccctgcacgtggcccacgtgagatacatccgcacctacatcaaggctcctatcatggaagagatcaagggatcccgaggcgacagatccgctgctgaaagcgtgctgtggacccagtggttcccttacggcgatggcgagatcggacctaacggcctgcttaaaaccaacggcagcttcaagttccccttttacctggtgggcatgggcgctatcgacgacgacctgatcgagctgtccaacgccgatccaatcgaccacccacagaaggccatcgccagcgtgcacctgaataccgacgaggaactgttctttggcaacaccggcagcgacagcaaccctgtggaagccgtggaaggctggtttgccagctggaaatctgccggaattaacatggccctgatcgtgctgtgtgtgctgctggtgctgatcttcctcagaagcctgcccgccctgatcaagctgatccacagataccgggtcagcagatctcggcagaccgacgtcgagctgaacagtatcaacgagacagccagaaccggctccgtgggaccagatatcattcccggagcctggcgggtgcatgatagcggcgtgcggcaaagccagtttttccggaacaaccctagacggctgggcccc

SEQ ID NO: 1248 - DNA, 1677 bp, synthetic construct
  misc_feature 1..1677: note = pGP86 YBV sequence
  source 1..1677: mol_type = other DNA
atgatcagctccacactgattctggtgatcatcagcgcccacgccttctgcgacatgatcattcctttccctgacgtgacaaccaccagctggaagcctgtgctgaggggcgagcaccattgccccgccagcaacgacctggacatggccggcggactgagcacccttaagatgaacgtgaagatcccctctggagtggtgggatctaagtccgatggctacctgtgtcacggagccaagtgggtgacaacctgcgattacagatggtacggcgccaagtatatcacccacagcctgcatcctctgagaccaagcacatctcagtgcttcgacgccatcaaggcctaccgcgagggcaccctgctgagcccaggctttccccctgaatcttgcggctggaacagcgtgaccgacagtgaactgctgtctatccaaatcactccccaccacagcggcgtggacgactacagaggcgtgtggatcgactctatgttcccaaagggcgagtgcgaccagagaatctgcgacacagtgcaggagcacagcatttggatcgccgccaacaacgtctctagcgcctgcagcatcgcctttaaacagctggaaggatacttctactaccggaacagtggtattcagcctaacaaggacggcaccttctttcacagcagccaccaccctaattcccctatgagctcctgttgtaggatcaaatactgcaaccaggaggggctgcggctgcatacaggcgagtggatcggcgtggcctggaataccaagattcgggacgtgacactggacagctacacagacacctgtcctggcggcacagaggtgaaatccaccatcggaagctcccccaccagagtggtcgcttgggagatggaaagaatcatggacttcgccctctgccagaacgtgtgggacaaggtgaacagaggcgagcagctgagcccactggatctgtcttacctgagctcaagagcccctggcaagggcctggcctacaccatcatcaacgagacactgcacgtggctcacgtgcggtatatcagaacatggatcaagggcccggtcctgaaggaaatcaaaggcagacgcggcagcagctccgccgctgaagataccctgtggatccaatggttccctttcggcgacaaccagatcggccccaacggcctgctgaaaagcaacggcacattcaagttccctttttacctcgtgggagtgggcgccctggatgaggatctgatcgaaatggccaatgctgatcctgtggatcacctgcaaagagtggacgccgaaacccacatgaggggcgatgaggagctgttctttggcgacaccggcgttagtaagaaccccatcgagagcgtcgagggctggttcagcaattggatcagcggcctgttcaacatcagcatcatcgtgctgtgcgtgctgtctgtgctgatcgtgttcaagagcgtgatcaccctgatcagagtggtgcggagacggagacggcccagagccgaggaagatgtggaactgaacaatatgaacccaagacctcagaccagacagcctgttggagctcctaacatcatccctggagcctggggcatccagcctagccacggcagaggcgtgcggcagagccagttcgtgaagcggtccgctctgaacatcgtgacc

SEQ ID NO: 1249 - DNA, 1533 bp, synthetic construct
  misc_feature 1..1533: note = pGP93 VSV CEN sequence
  source 1..1533: mol_type = other DNA
atgaagtgcctgctgtacctggccctgctgttcatcggagtgtactgcaagttcacaaccgtctttcctcacaacaagaagggcgactggaaaaacgtgccctctaactaccactactgtccttccagctctgatctgaactggcacaacgacctgatcggtaccgccctgcaggttaagatgcctaaaagccacaaggctatccaggccgatggctggatgtgccacgcctctaagtgggtcaccacctgcgatttcagatggtatggccccaagtacatcacacacagcatccggagcttcacccctagcgtggaacaatgtaaagagagcatcgagcaaacaaagcagggcacctggctgaaccctggcttcccacctcagagctgcggctacgccacagtgaccgacgccgaggccgtgatcgtgcaggttacacctcatcacgtgctcgtggacgagtacaccggcgaatgggtggacagccagttcatcaacggcaaatgcagcgacgatatctgccccaccgtgcacaacagcaccacatggcattctgactacaaggtgaagggcctgtgtgatagcaatctgattagcatggacatcaccttctttagcgaggacggagaactgagctctctgggaaaggaaggtaccgggtttagaagcaactacttcgcctacgagacaggcgataaggcctgcaagatgcagtactgcaagcactggggagtgcggctgccttctggcgtgtggttcgagatggccgacaagaatctgttcgccgctgctaagttccctgaatgccctgagggctccagcatcagcgccccttcacagacctctgtggatgtgagcctgatccaggacgtggaacggatcctggattacagcctgtgtcaggagacctggtccaagatcagagccggcctccccatcagccctgtggacctgagctacctggctcctaagaaccctggcacaggcccagccttcaccatcatcaacggcaccctgaagtacttcgagacaagatacatccgggtggacatcgccgctcctatcctgagcagaatggtgggcatgatctccggcacaacaaccgaaagagagctgtgggaggactgggccccctacgaggacgtggaaatcggcccgaatggcgtgctgaggacctccagcggctataagtttccactgtacatgatcggccacggcatgctggacagcgacctgcacctgagcagcaaagcccaggtgttcgagcacccacacatccccgacgccaccagccagctgcctgatgacgaaacactgtttttcggcgacaccggactctccaaggaccccattgagctggtcgaaggctggttcagcggctggaagtcctccatcgcttcttttttcttcatcatcggacttattattggactgttcttcgtgctgcgcatcggcgtgtatctgtgcatcaagctgaagcacaccaacaaaagacagatctacaccgatatcgagatgaacagactgggcaag

SEQ ID NO: 1250 - DNA, 1533 bp, synthetic construct
  misc_feature 1..1533: note = pGP95 VSV South America 85CLB sequence
  source 1..1533: mol_type = other DNA
atgaaatgcctgctgtgtctggcctttctgttcatcggagtcaactgcaagttcaccatcgtgttccctcacaaccagaagggcaattggaagaacgtgcccagcaactaccactactgccccagcagcagcgacctgaactggcacaatgatctgatcggcaccgccctgcaggttaagatgcctaaaagccacaaggccatccaagccgacggctggatgtgccacgcctctaaatggatcaccacctgtgacttcagatggtacggccccaagtacatcacccactctattcagtccttcacgcccagcgtggaacagtgcaaggaaagcatcgagcaaacaaagcagggcacctggctgaaccctggcttcccaccacagagctgcggatatgccaccgtgacagacgccgaggccgtgatcgtccaggtgacccctcaccacgtgctggtggacgagtacacaggcgagtgggtggacagccagttcatcaacggcaagtgcagcaacgacatctgcctgaccgtgcacaacagcacaacctggcattctgattacaaggtgaagggcctctgtgattctaaccttatcagcatggatatcacattcttcagcgaggacggcgaactgtctagtctgggcaaggctggcacaggatttagatccaattactttgcctacgagacaggcgataaggcttgtaaaatgcagtactgcaagcactggggcgtgcggctgcccagcggcgtgtggtttgagatggccgacaaggacctgttcgccgcagccaagttcccagagtgcccagaaggcagcagcatcagcgccccttctcagacctctgtggacgtgtccctgatccaggatgtggagagaatcctggactactcactgtgccaggagacatggtccaagatccgcgccggcctgcccatcagccctgtggacctgagctacctggctcctaagaatcccggcaccggtcctgccttcaccatcatcaacggaaccctgaaatatttcgagacaagatacataagagtggatatcgctgcccctattctgagtagaatggtgggcatgatcagcggaaccaacaccgagcgggaactgtgggaggactgggccccttacgaggatgtggaaatcggccctaacggcgttctgagaactagcagcggctataagtttcctctgtacatgattggacatggcatgctggacagcgacctgcacctatccagcaaagtgcaggtgttcgagcaccctcacatccaagatgctgccagccagctgcctgacgacgaaaccctgttcttcggcgacaccggcctgtccaagaaccctatcgaactggtcgagggctggttcagcggatggaagtcttccatcgccagcttcttcttcatcatcggcctgatcattggcctgttcctggtgctgcgggtgggaatctacctctgtatcaagctgaagcacaccagaaagcggaaaatctacgccgatatcgaaatgaacaggctgggaaag

SEQ ID NO: 1251 - DNA, 4563 bp, synthetic construct; identical to SEQ ID NO: 1144
  misc_feature 1..4563: note = pXDP17 sequence
  source 1..4563: mol_type = other DNA

SEQ ID NO: 1252 - DNA, 2465 bp, synthetic construct; identical to SEQ ID NO: 1153
  misc_feature 1..2465: note = pSG17 sequence
  source 1..2465: mol_type = other DNA

SEQ ID NO: 1253 - DNA, 2413 bp, synthetic construct; identical to SEQ ID NO: 1048
  misc_feature 1..2413: note = pSG005 sequence
  source 1..2413: mol_type = other DNA

SEQ ID NO: 1254 - DNA, 5178 bp, synthetic construct; identical to SEQ ID NO: 1090
  misc_feature 1..5178: note = pXDP40 sequence
  source 1..5178: mol_type = other DNA

SEQ ID NO: 1255 - DNA, 4914 bp, synthetic construct
  misc_feature 1..4914: note = pXDP145 sequence
  source 1..4914: mol_type = other DNA
gccaccatggaagccgtgatcaaggtgatcagctccgcatgcaagacctactgtggcaagacgagcccaagcaagaaggaaatcggcgctatgctgagcctgctgcagaaggagggcctcctgatgagcctgtctgatctgtacagcccaggtagctgggaccctatcaccgccgccctgacacagagagccatggtgctgggcaaaagcggcgagctgaagacatggggactggtgctgggcgccctgaaagccgctagagaagagcaagtaaccagcgagcaggccaagttctggctgggactgggcggcggtagagtgagcccccctggccctgagtgcatcgagaagcctgccaccgagcggcgcattgacaaaggcgaagaagtgggcgagacaaccgtgcagagagacgccaagatggctccagaagagacagcaaccccaaagaccgtgggcaccagctgctaccactgcggcaccgctatcggctgcaactgcgccaccgccagcgcgcctcctcccccgtatgtgggcagcggcctctacccctccctggcaggagtgggagagcagcagggccagggcggagatacacccagaggcgccgagcagcctagagccgaacccggccacgccggccaggcccctggccccgccctgaccgactgggccagaatcagagaggagctggcctctacaggccctccagtggtcgccatgcctgtggtgatcaagaccgagggacctgcctggacccctctggaacctaaactgattacacggctggctgataccgtcagaaccaagggcctcagaagccccatcacaatggccgaagtggaagccctgatgagcagcccactgctgcctcacgacgtgaccaacctgatgcgggtgatcctgggccccgccccttacgccctgtggatggacgcctggggcgtgcagctgcaaacagttatcgccgccgccacaagagacccccggcacccagccaacggccagggcagaggcgagagaacaaacctggatcggctgaagggcctcgccgatggcatggccggcaatcctgagggccaggctgctctgctgagacccggggaactggttgctatcaccgccagcgccctgcaggccttcagagaagtggcccggctggccgagcctacagacccctgggccgagatcacccagggcccttctgagagcttcgtggacttcgccaacagactgatcaaggccgttgagggctccgacctgcctcctagcgcccgcgcccccgtgatcatcgactgttttagacagaaatcgcaacccgacatccagcagctgatccgggccgctccttctaccctgaccacacctggcgagatcatcaagtacgtgctggacagacagaagaccgcccccctgaccgacagaggaatcgccgccgccatgtctagcgccattcagcctctggtgatggccgtggtcaacagagaaagagatggacagacaggttctggcggcagagcccggggcctgtgctacacctgcggatcccctggacactaccaggcccagtgtcctaagaaaagaaagtctggtaacagcagagagcggtgccagctgtgtgatggcatgggccacaacgccaaacagtgccggagacgggacggaaaccaaggacaaagacccggccggggactgagcagcggaccttggcctgtcagccagcaacctgccgtgtccggagggccactgttcttactgttgcgctacatctggctattccgctcaaatggaagccagaccacacgcctgtgtggattgaccagtggccccttcctgaaggtaaacttgcgcggtgccaccagctgctaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1256 - DNA, 1692 bp, synthetic construct
  misc_feature 1..1692: note = pGP80 H5N1 sequence
  source 1..1692: mol_type = other DNA
atggagaggatcgtgctgctgctggccatcgtgagcctggtgaagagcgaccagatctgcatcggctaccacgccaacaagagcaccaagcaggtggacaccatcatggagaagaacgtgaccgtgacccacgcccaggacatcctggagaggacccacaacggcaagctgtgcagcctgaacggcgtgaagcccctgatcctgagggactgcagcgtggccggctggctgctgggcaaccccatgtgcgacgagttcctgaacgtgcccgagtggagctacatcgtggagaaggacaaccccatcaacagcctgtgctaccccggcgacttcaacgactacgaggagctgaagcacctgctgagcagcaccaaccacttcgagaagatccagatcatccccaggagcagctggagcaaccacgacgccagcagcggcgtgagcagcgcctgcccctacatcggcaggagcagcttcttcaggaacgtggtgtggctgatcaagaaggacaacgcctaccccaccatcaagaggagctacaacaacaccaaccaggaggacctgctgatcctgtggggcatccaccaccccaacgacgccgccgagcagaccaagctgtaccagaaccccaccacctacgtgagcgtgggcaccagcaccctgaaccagaggagcatccccgagatcgccaccaggcccaaggtgaacggccagagcggcaggatggagttcttctggaccatcctgaagcccaacgacgccatcaacttcgagagcaacggcaacttcatcgcccccgagtacgcctacaagatcgtgaagaagggcgacagcgccatcatgaagagcggcctggcctacggcaactgcgacaccaagtgccagacccccgtgggcgccatcaacagcagcatgcccttccacaacatccacccccacaccatcggcgagtgccccaagtacgtgaagagcgacaggctggtgctggccaccggcctgaggaacgtgccccagaggaagaagaggggcctgttcggcgccatcgccggcttcatcgagggcggctggcagggcatggtggacggctggtacggctaccaccacagcaacgagcagggcagcggctacgccgccgacaaggagagcacccagaaggccatcgacggcatcaccaacaaggtgaacagcatcatcgacaagatgaacacccagttcaaggccgtgggcaaggagttcaacaacctggagaggagggtggagaacctgaacaagaagatggaggacggcttcctggacgtgtggacctacaacgtggagctgctggtgctgatggagaacgagaggaccctggacttccacgacagcaacgtgaagaacctgtacgacaaggtgaggctgcagctgaaggacaacgccagggagctgggcaacggctgcttcgagttctaccacaagtgcgacaacgagtgcatggagagcgtgaggaacggcacctacgactacccccagtacagcgaggaggccaggctgaacagggaggagatcagcggcgtgaagctggagagcatgggcgtgtaccagatcctgagcatctacagcaccgtggccagcagcctggccctggccatcatgatcgccggcctgagcttctggatgtgcagcaacggcagcctgcagtgcaggatctgcatc

SEQ ID NO: 1257 - DNA, 1680 bp, synthetic construct
  misc_feature 1..1680: note = pGP81 H7N9 sequence
  source 1..1680: mol_type = other DNA
atgaacacccagatcctggtgttcgccctgatcgccatcatccccaccaacgccgacaagatctgcctgggccaccacgccgtgagcaacggcaccaaggtgaacaccctgaccgagaggggcgtggaggtggtgaacgccaccgagaccgtggagaggaccaacatccccaggatctgcagcaagggcaagaggaccgtggacctgggccagtgcggcctgctgggcaccatcaccggccccccccagtgcgaccagttcctggagttcagcgccgacctgatcatcgagaggagggagggcagcgacgtgtgctaccccggcaagttcgtgaacgaggaggccctgaggcagatcctgagggagagcggcggcatcgacaaggaggccatgggcttcacctacagcggcatcaggaccaacggcgccaccagcgcctgcaggaggagcggcagcagcttctacgccgagatgaagtggctgctgagcaacaccgacaacgccgccttcccccagatgaccaagagctacaagaacaccaggaagagccccgccctgatcgtgtggggcatccaccacagcgtgagcaccgccgagcagaccaagctgtacggcagcggcaacaagctggtgaccgtgggcagcagcaactaccagcagagcttcgtgcccagccccggcgccaggccccaggtgaacggcatcagcggcaggatcgacttccactggctgatgctgaaccccaacgacaccgtgaccttcagcttcaacggcgccttcatcgcccccgacagggccagcttcctgaggggcaagagcatgggcatccagagcggcgtgcaggtggacgccaactgcgagggcgactgctaccacagcggcggcaccatcatcagcaacctgcccttccagaacatcgacagcagggccgtgggcaagtgccccaggtacgtgaagcagaggagcctgctgctggccaccggcatgaagaacgtgcccgagatccccaagggcaggggcctgttcggcgccatcgccggcttcatcgagaacggctgggagggcctgatcgacggctggtacggcttcaggcaccagaacgcccagggcgagggcaccgccgccgactacaagagcacccagagcgccatcgaccagatcaccggcaagctgaacaggctgatcgagaagaccaaccagcagttcgagctgatcgacaacgagttcaacgaggtggagaagcagatcggcaacgtgatcaactggaccagggacagcatcaccgaggtgtggagctacaacgccgagctgctggtggccatggagaaccagcacaccatcgacctggccgacagcgagatggacaagctgtacgagagggtgaagaggcagctgagggagaacgccgaggaggacggcaccggctgcttcgagatcttccacaagtgcgacgacgactgcatggccagcatcaggaacaacacctacgaccacagcaagtacagggaggaggccatgcagaacaggatccagatcgaccccgtgaagctgagcagcggctacaaggacgtgatcctgtggttcagcttcggcgccagctgcttcatcctgctggccatcgtgatgggcctggtgttcatctgcgtgaagaacggcaacatgaggtgcaccatctgcatc

SEQ ID NO: 1258 - DNA, 2949 bp, synthetic construct
  misc_feature 1..2949: note = pGP65 EEEV sequence
  source 1..2949: mol_type = other DNA
atgtcgctcgccactgtcatgtgcgtcctggccaatatcacgtttccatgtgatcaaccaccctgcatgccatgctgttatgaaaagaatccacacgaaacactcaccatgctggaacagaattacgacagccgagcctatgatcagctgctcgatgccgctgtgaaatgtaatgctaggagaaccaggagagatttggacactcatttcacccagtataagttggcacgcccgtatattgctgattgccctaactgtgggcatagtcggtgcgacagccctatagctatagaagaagtcagaggggatgcgcatgcaggagtcatccgcatccagacatcagctatgtttggtctgaagacggatggagtcgatttggcctacatgagtttcatgaacggcaaaacgcagaaatcaataaagatcgacaacctgcatgtgcgcacctcagccccttgttccctcgtgtcgcaccacggctattacatcttggctcaatgcccaccaggggacacggttacagttgggtttcacgacgggcctaaccgccatacgtgcacagttgcccataaggtagaattcaggccagtgggtagagagaaataccgtcacccacctgaacatggagttgaattaccgtgtaaccgttacactcacaagcgtgcagaccaaggacactatgttgagatgcatcaaccagggctagttgccgaccactctctccttagcatccacagtgccaaggtgaaaattacggtaccgagcggcgcccaagtgaaatactactgcaagtgtccagatgtacgagagggaattaccagcagcgaccatacaaccacctgcacggatgtcaaacaatgcagggcttacctgattgacaacaagaaatgggtgtacaactctggaagactgcctcgaggagagggcgacacttttaaaggaaaacttcatgtgccctttgtgcctgttaaggccaagtgcatcgccacgctggcaccggagcctctagttgagcacaaacaccgcaccctgattttacacctgcacccggaccacccgaccttgctgacgaccaggtcacttggaagtgatgcaaatccaactcgacaatggattgagcgaccaacaactgtcaatttcacagtcaccggagaagggttggagtatacctggggaaaccatccaccaaaaagagtatgggctcaagagtcaggagaagggaacccacatggatggccgcacgaagtggtagtctattactacaacagatacccgctaaccacaattatcgggttatgcacctgtgtggctatcatcatggtctcttgtgtcacatccgtgtggctcctttgcaggactcgcaatctttgcataaccccgtataaactagccccgaacgctcaagtcccaatactcctggcgttactttgctgcattaagccgacgagggcagacgacaccttgcaagtgctgaattatctgtggaacaacaatcaaaactttttctggatgcagacgcttatcccacttgcagcgcttatcgtatgcatgcgcatgctgcgttgcttattttgctgtgggccggcttttttacttgtctgcggcgccttgggcgccgcagcgtacgaacacacagcagtgatgccgaacaaggtggggatcccgtataaagctttagtcgaacgcccagggtatgcacccgttcacctacagatacagctggttaataccaggataattccatcaactaacctggagtacatcacctgcaagtacaagacaaaagtgccgtctccagtagtgaaatgctgcggtgccactcaatgtacctctaaaccccatcctgactatcagtgtcaggtgtttacaggtgtttacccattcatgtggggaggagcctactgcttctgcgacaccgaaaacacccagatgagcgaggcgtatgtagagcgctcggaagagtgctctatcgaccacgcaaaagcttataaagtacacacaggcactgttcaggcaatggtgaacataacttatgggagcgtcagctggagatctgcagatgtctacgtcaatggtgaaactcccgcgaaaataggagatgccaaactcatcataggtccactgtcatctgcgtggtccccattcgataacaaggtggtggtttatgggcatgaagtgtataattacgactttcctgagtacagcaccggcaaagcaggctctttcggagacctgcaatcacgcacatcaaccagcaacgatctgtacgcaaataccaacttgaagctacaacgaccccaggctggtatcgtgcacacacctttcacccaggcgccctctggcttcgaacgatggaaaagggacaaaggggcaccgttgaacgacgtagccccgtttggctgttcaattgccctggagccgctccgtgcagaaaattgtgcagtgggaagcatccctatatctatagatatacccgatgcggctttcaccagaatatctgaaacaccgacagtctcagacctggaatgcaaaattacggagtgtacttatgcctccgatttcggtggtatagccaccgttgcctacaaatccagtaaagcaggaaactgtccaattcattctccatcgggtgttgcagttattaaagagaatgacgtcacccttgctgagagcggatcatttacattccacttctccactgcaaacatccatcctgcttttaagctgcaggtctgcaccagtgcagttacctgcaaaggagattgcaagccaccgaaagatcatatcgtcgattatccagcacaacataccgaatcctttacgtcggcgatatccgccaccgcgtggtcgtggctaaaagtgctggtaggaggaacatcagcatttattgttctggggcttattgctacagcagtggttgccctagttctgttcttccatagacattaa

SEQ ID NO: 1259 - DNA, 2946 bp, synthetic construct
  misc_feature 1..2946: note = pGP66 VEEV sequence
  source 1..2946: mol_type = other DNA
atgtcactagtgaccactatgtgcctgctcgccaatgtgacgttcccatgtgccgaaccaccaatttgctacgacagaaaaccagcagagactttggccatgctcagcgttaacgttgacaacccgggctacgatgagctactggaagcagctgttaagtgccccggaagaaaaaggagatctaccaaggagctgtttaaggagtataagctaacgcgcccttacatggccagatgcatcagatgtgccgttgggagctgccatagtccaatagcaattgaggcagtgaagagcgacgggcacgacggctatgttagacttcagacttcctcgcagtatggcctggattcctctggcaacttaaagggaaggactatgcggtatgatatgcacgggaccattgaagagataccactacatcaagtgtcactccacacatctcgcccgtgtcacattgtggatgggcatggttattttctgcttgctaggtgcccggcaggggactccatcaccatggaatttaagaaaggttcagtcacacactcctgctcagtgccgtatgaagtgaaatttaatcctgtaggcagagaactctacactcatccaccagaacacggagcagagcaagcgtgccaagtctacgcgcacgatgcacagaacagaggagcttatgtcgagatgcacctcccgggctcagaagtggacagcagtttgatttccttgagcggcagttcagtcaccgtgacacctcctgtcgggactagcgccttggtggaatgcaagtgcggcggcacaaagatctccgaaaccatcaacaaggcaaaacagttcagccagtgcacaaagaaggagcagtgcagagcatatcgactgcagaatgacaagtgggtgtataattctgacaaactgcccaaagcagcgggagccaccctaaaaggaaaactacacgtcccgttcttgctggcagacggcaaatgcaccgtgcctctagcaccggaacctatgataaccttcggtttccgatcagtgtcactgaaactgcaccctaagaatcccacatatctgaccactcgccaacttgctgatgagcctcattacacgcacgagctcatatctgaaccagctgttaggaattttaccgtcactgaaaaggggtgggagtttgtatggggaaaccatccgccgaaaaggttttgggcacaggaaacagcacccggaaatccacatgggctgccacatgaggtgataactcattattaccacagataccctatgtccaccatcctgggtttgtcaatttgcgccgccattgtaaccgtttccgttgcagcgtccacctggctgttttgcaaatccagagtttcgtgcctaactccttaccggctaacacctaacgccaggatgccgctttgcctggccgtgctttgctgcgcccgcactgcccgggccgagaccacctgggagtccttggatcacctatggaacaataaccaacagatgttctggattcaattgctgatccctctggccgccttgattgtagtgactcgcctgctcaagtgcgtgtgctgtgtagtgccttttttagtcgtggccggcgccgcaggcgccggcgcctacgagcacgcgaccacgatgccgagccaagcgggaatctcgtataacaccatagtcaacagagcaggctacgcgccactccctatcagcataacaccaacaaagatcaagctgatacccacagtgaacttggagtacgtcacctgccactacaaaacaggaatggattcaccagccatcaaatgctgcggatctcaggaatgtactccaactaacaggcctgatgaacagtgcaaagtcttcacaggggtttacccgttcatgtggggaggtgcatattgcttttgcgacactgagaatactcaggtcagcaaggcctacgtaatgaaatctgacgactgccttgcggatcatgctgaagcatacaaagcgcacacagcctcagtgcaggcgttcctcaacatcacagtgggggaacactctattgtgaccaccgtgtatgtgaatggagaaactcctgtgaacttcaatggggtcaaactaactgcaggtccactttccacagcttggacaccctttgacagaaaaatcgtgcagtatgccggggagatctataattacgattttcctgagtatggggcaggacaaccaggagcatttggagacatacaatccagaacagtctcaagctcagatctgtatgccaataccaacctagtgctgcagagacccaaagcaggagcgatccatgtgccatacactcaggcaccatcgggttttgagcaatggaagaaagataaagctccgtcattgaaattcaccgcccctttcggatgcgaaatatatacaaaccccattcgcgccgaaaattgtgctgtagggtcaattccattagcctttgacattcccgacgccttgttcaccagggtgtcagaaacaccgacactttcagcggccgaatgcactcttaacgagtgcgtgtattcatccgactttggcgggatcgccacggtcaagtattcggccagcaagtcaggcaagtgcgcagtccatgtgccatcagggactgctaccctaaaagaagcagcagtcgagctaaccgagcaagggtcggcgaccattcatttctcgaccgcaaatatccacccggagttcaggctccaaatatgcacatcatatgtcacgtgcaaaggtgattgtcaccccccgaaagaccacattgtgacacacccccagtatcacgcccaaacatttacagccgcggtgtcaaaaaccgcgtggacgtggttaacatccctgctgggaggatcggccgtaattattataattggcttagtgctggctactattgtggccatgtacgtgctgaccaaccagaaacataattga

SEQ ID NO: 1260 - DNA, 2937 bp, synthetic construct
  misc_feature 1..2937: note = pGP67 WEEV sequence
  source 1..2937: mol_type = other DNA
atgtcactagttacagcactgtgcgtgctttcgaatgttacgttcccatgcgataaaccacccgtgtgctattcactggcgccagaacgaacactcgacgtgctcgaggagaacgtcaacaatccaaattacgacacgctgctggagaacgtcttgaaatgtccgtcacgccggcccaaacgaagcattaccgatgacttcacactgaccagtccctacctagggttctgcccgtattgcagacactcagcgccgtgtttcagcccaataaaaattgagaacgtgtgggacgaatctgatgatggatcgattagaatccaggtctcggcacaattcggctatgatcaggcaggcactgcagatgtcaccaaattccgttacatgtcttacgaccacgaccatgacatcaaggaagacagtgtgaagaaaatagctattagtacatctggaccctgccgtcgtcttggccacaaagggtacttcctgttagctcaatgtcctccaggtgacagtgtaaccgtcagtatcacgagcggagcatctgagaattcatgcaccgtggagaaaaagatcaggaggaagtttgtcggtagagaggagtacttgttcccacctgtccatggaaagctggtaaagtgccacgtttacgatcacttgaaggagacgtctgccggatacataaccatgcacaggccaggcccacacgcgtataagtcctatctggaggaagcgtcaggcgaagtgtacattaaaccaccttctggcaagaacgtcacctacgaatgtaagtgtggcgactacagcacaggtattgtgagcacgcgaacgaagatgaacggctgcaccaaagcaaaacagtgcattgcctacaagagcgaccaaacgaaatgggtctacaactcgccggatcttattaggcacacagaccactcagtgcaaggtaaactgcacattccattccgcttgacaccgacattctgcccggttccgttagctcacacgcctacagtcacgaagtggtttaaaggcatcaccctccacctgactgcaacgcgaccaacattgctgacaacgagaaaattggggctgcgagcagacgcaacagcagaatggattacagggactacatccaggaatttttctgtggggcgagaagggctggagtacgtatggggcaaccatgaaccagtcagagtctgggcccaggagtcggcaccaggcgacccgcatggatggccgcatgagatcatcatccactattatcatcggcatccagtctacactgtcattgtgctgtgcggtgtcgctcttgctatcctggtaggcattgcatcgtcagcagcttgtatcgccaaagcaagaagagactgcctgacgccatacgcgcttgcaccgaacgcaacggtacccacagcattagcagttttgtgctgtattcggccaaccaacgcagaaacatttggagaaactttgaatcatctgtggtttaacaaccaaccgtttctctgggcacagttgtgcatccctctggcagcgcttattattctgtttcgctgcttttcatgctgcatgccttttttattggttgcaggcgtctgcctggggaaggtagacgccttcgaacatgcgaccactgtgccaaatgttccggggatcccgtataaggcgttggtcgaacgtgcaggttacgcgccacttaatctggagattacggtcgtctcatcggaattaacaccctcaactaacaaggagtatgtgacctgcaaattccacacagtcattccttcaccgcaagttaaatgctgcgggtccctcgagtgtaaggcatcctcaaaagcggattacacatgccgcgtttttggcggtgtgtaccctttcatgtggggaggcgcacagtgcttctgtgacagtgagaacacacaactgagtgaggcatacgtcgagttcgctccagactgcactatagatcatgcagtcgcactaaaagttcacacagctgctctgaaagtcggcctgcgtatagtatacggcaataccaccgcgcacctggatacgttcgtcaatggcgtcacgccaggttcctcacgggacctgaaggtcatagcagggccgatatcagccgctttttcaccctttgaccataaggtcgtcatcagaaaggggcttgtttataactacgacttccctgagtatggagctatgaaaccaggagcgttcggcgatattcaagcatcctcgcttgatgccacagacatagtagcccgcactgacatacggctgctgaagccttctgtcaagaacatccacgtcccctacacccaagcagtatcagggtatgaaatgtggaagaacaactcaggacgacccctgcaagaaacagcaccatttggatgtaaaattgaagtggagcctctgcgagcgtctaattgtgcttatgggcacatccctatctcgattgacatccctgatgcagcttttgtgagatcatcagaatcaccaacaattttagaagtcagctgcacagtagcagactgcatttattctgcagactttggtggttcgctaacactacagtacaaagctgacagggagggacattgtccagttcactcccactccactacagctgttttgaaggaagcgaccacacatgtgactgccacaggcagcataacactacattttagcacatcgagcccacaagcaaatttcatagtttcgctatgcggcaagaagaccacttgcaatgctgaatgtaaaccaccggccgaccacataattggagaaccacataaggtcgaccaagaattccaggcggcagtttccaaaacatcttggaactggctgcttgcactgtttgggggagcatcatccctcattgctgtaggacttatagtgttggtctgcagctctatgcttataaacacacgtagatga

SEQ ID NO: 1261 - DNA, 2964 bp, synthetic construct
  misc_feature 1..2964: note = pGP68 semliki forest virus sequence
  source 1..2964: mol_type = other DNA
atgtccgccccgctgattactgccatgtgtgtccttgccaatgctaccttcccgtgcttccagcccccgtgtgtaccttgctgctatgaaaacaacgcagaggccacactacggatgctcgaggataacgtggataggccagggtactacgacctccttcaggcagccttgacgtgccgaaacggaacaagacaccggcgcagcgtgtcgcaacacttcaacgtgtataaggctacacgcccttacatcgcgtactgcgccgactgcggagcagggcactcgtgtcatagccccgtagcaattgaagcggtcaggtccgaagctaccgacgggatgctgaagattcagttctcggcacaaattggcatagataagagtgacaatcatgactacacgaagataaggtacgcagacgggcacgccattgagaatgccgtccggtcatctttgaaggtagccacctccggagactgtttcgtccatggcacaatgggacatttcatactggcaaagtgcccaccgggtgaattcctgcaggtctcgatccaggacaccagaaacgcggtccgtgcctgcagaatacaatatcatcatgaccctcaaccggtgggtagagaaaaatttacaattagaccacactatggaaaagagatcccttgcaccacttatcaacagaccacagcggagaccgtggaggaaatcgacatgcatatgccgccagatacgccggacaggacgttgctatcacagcaatctggcaatgtaaagatcacagtcggaggaaagaaggtgaaatacaactgcacctgtggaaccggaaacgttggcactactaattcggacatgacgatcaacacgtgtctaatagagcagtgccacgtctcagtgacggaccataagaaatggcagttcaactcacctttcgtcccgagagccgacgaaccggctagaaaaggcaaagtccatatcccattcccgttggacaacatcacatgcagagttccaatggcgcgcgaaccaaccgtcatccacggcaaaagagaagtgacactgcaccttcacccagatcatcccacgctcttttcctaccgcacactgggtgaggacccgcagtatcacgaggaatgggtgacagcggcggtggaacggaccatacccgtaccagtggacgggatggagtaccactggggaaacaacgacccagtgaggctttggtctcaactcaccactgaagggaaaccgcacggctggccgcatcagatcgtacagtactactatgggctttacccggccgctacagtatccgcggtcgtcgggatgagcttactggcgttgatatcgatcttcgcgtcgtgctacatgctggttgcggcccgcagtaagtgcttgaccccttatgctttaacaccaggagctgcagttccgtggacgctggggatactctgctgcgccccgcgggcgcacgcagctagtgtggcagagactatggcctacttgtgggaccaaaaccaagcgttgttctggttggagtttgcggcccctgttgcctgcatcctcatcatcacgtattgcctcagaaacgtgctgtgttgctgtaagagcctttcttttttagtgctactgagcctcggggcaaccgccagagcttacgaacattcgacagtaatgccgaacgtggtggggttcccgtataaggctcacattgaaaggccaggatatagccccctcactttgcagatgcaggttgttgaaaccagcctcgaaccaacccttaatttggaatacataacctgtgagtacaagacggtcgtcccgtcgccgtacgtgaagtgctgcggcgcctcagagtgctccactaaagagaagcctgactaccaatgcaaggtttacacaggcgtgtacccgttcatgtggggaggggcatattgcttctgcgactcagaaaacacgcaactcagcgaggcgtacgtcgatcgatcggacgtatgcaggcatgatcacgcatctgcttacaaagcccatacagcatcgctgaaggccaaagtgagggttatgtacggcaacgtaaaccagactgtggatgtttacgtgaacggagaccatgccgtcacgatagggggtactcagttcatattcgggccgctgtcatcggcctggaccccgttcgacaacaagatagtcgtgtacaaagacgaagtgttcaatcaggacttcccgccgtacggatctgggcaaccagggcgcttcggcgacatccaaagcagaacagtggagagtaacgacctgtacgcgaacacggcactgaagctggcacgcccttcacccggcatggtccatgtaccgtacacacagacaccttcagggttcaaatattggctaaaggaaaaagggacagccctaaatacgaaggctccttttggctgccaaatcaaaacgaaccctgtcagggccatgaactgcgccgtgggaaacatccctgtctccatgaatttgcctgacagcgcctttacccgcattgtcgaggcgccgaccatcattgacctgacttgcacagtggctacctgtacgcactcctcggatttcggcggcgtcttgacactgacgtacaagaccaacaagaacggggactgctctgtacactcgcactctaacgtagctactctacaggaggccacagcaaaagtgaagacagcaggtaaggtgaccttacacttctccacggcaagcgcatcaccttcttttgtggtgtcgctatgcagtgctagggccacctgttcagcgtcgtgtgagcccccgaaagaccacatagtcccatatgcggctagccacagtaacgtagtgtttccagacatgtcgggcaccgcactatcatgggtgcagaaaatctcgggtggtctgggggccttcgcaatcggcgctatcctggtgctggttgtggtcacttgcattgggctccgcagataa

SEQ ID NO: 1262 - DNA, 2949 bp, synthetic construct
  misc_feature 1..2949: note = pGP69 Sindbis virus sequence
  source 1..2949: mol_type = other DNA
atgtccgcagcaccactggtcacggcaatgtgtttgctcggaaatgtgagcttcccatgcgaccgcccgcccacatgctatacccgcgaaccttccagagccctcgacatccttgaagagaacgtgaaccatgaggcctacgataccctgctcaatgccatattgcggtgcggatcgtctggcagaagcaaaagaagcgtcattgacgactttaccctgaccagcccctacttgggcacatgctcgtactgccaccatactgtaccgtgcttcagccctgttaagatcgagcaggtctgggacgaagcggacgataacaccatacgcatacagacttccgcccagtttggatacgaccaaagcggagcagcaagcgcaaacaagtaccgctacatgtcgcttaagcaggatcacaccgttaaagaaggcaccatggatgacatcaagattagcacctcaggaccgtgtagaaggcttagctacaaaggatactttctcctcgcaaaatgccctccaggggacagcgtaacggttagcatagtgagtagcaactcagcaacgtcatgtacactggcccgcaagataaaaccaaaattcgtgggacgggaaaaatatgatctacctcccgttcacggtaaaaaaattccttgcacagtgtacgaccgtctgaaagaaacaactgcaggctacatcactatgcacaggccgagaccgcacgcttatacatcctacctggaagaatcatcagggaaagtttacgcaaagccgccatctgggaagaacattacgtatgagtgcaagtgcggcgactacaagaccggaaccgtttcgacccgcaccgaaatcactggttgcaccgccatcaagcagtgcgtcgcctataagagcgaccaaacgaagtgggtcttcaactcaccggacttgatcagacatgacgaccacacggcccaagggaaattgcatttgcctttcaagttgatcccgagtacctgcatggtccctgttgcccacgcgccgaatgtaatacatggctttaaacacatcagcctccaattagatacagaccacttgacattgctcaccaccaggagactaggggcaaacccggaaccaaccactgaatggatcgtcggaaagacggtcagaaacttcaccgtcgaccgagatggcctggaatacatatggggaaatcatgagccagtgagggtctatgcccaagagtcagcaccaggagaccctcacggatggccacacgaaatagtacagcattactaccatcgccatcctgtgtacaccatcttagccgtcgcatcagctaccgtggcgatgatgattggcgtaactgttgcagtgttatgtgcctgtaaagcgcgccgtgagtgcctgacgccatacgccctggccccaaacgccgtaatcccaacttcgctggcactcttgtgctgcgttaggtcggccaatgctgaaacgttcaccgagaccatgagttacttgtggtcgaacagtcagccgttcttctgggtccagttgtgcatacctttggccgctttcatcgttctaatgcgctgctgctcctgctgcctgccttttttagtggttgccggcgcctacctggcgaaggtagacgcctacgaacatgcgaccactgttccaaatgtgccacagataccgtataaggcacttgttgaaagggcagggtatgccccgctcaatttggagatcactgtcatgtcctcggaggttttgccttccaccaaccaagagtacattacctgcaaattcaccactgtggtcccctccccaaaaatcaaatgctgcggctccttggaatgtcagccggccgctcatgcagactatacctgcaaggtcttcggaggggtctacccctttatgtggggaggagcgcaatgtttttgcgacagtgagaacagccagatgagtgaggcgtacgtcgaattgtcagcagattgcgcgtctgaccacgcgcaggcgattaaggtgcacactgccgcgatgaaagtaggactgcgtattgtgtacgggaacactaccagtttcctagatgtgtacgtgaacggagtcacaccaggaacgtctaaagacttgaaagtcatagctggaccaatttcagcatcgtttacgccattcgatcataaggtcgttatccatcgcggcctggtgtacaactatgacttcccggaatatggagcgatgaaaccaggagcgtttggagacattcaagctacctccttgactagcaaggatctcatcgccagcacagacattaggctactcaagccttccgccaagaacgtgcatgtcccgtacacgcaggcctcatcaggatttgagatgtggaaaaacaactcaggccgcccactgcaggaaaccgcacctttcgggtgtaagattgcagtaaatccgctccgagcggtggactgttcatacgggaacattcccatttctattgacatcccgaacgctgcctttatcaggacatcagatgcaccactggtctcaacagtcaaatgtgaagtcagtgagtgcacttattcagcagacttcggcgggatggccaccctgcagtatgtatccgaccgcgaaggtcaatgccccgtacattcgcattcgagcacagcaactctccaagagtcgacagtacatgtcctggagaaaggagcggtgacagtacactttagcaccgcgagtccacaggcgaactttatcgtatcgctgtgtgggaagaagacaacatgcaatgcagaatgtaaaccaccagctgaccatatcgtgagcaccccgcacaaaaatgaccaagaatttcaagccgccatctcaaaaacatcatggagttggctgtttgcccttttcggcggcgcctcgtcgctattaattataggacttatgatttttgcttgcagcatgatgctgactagcacacgaagatga

SEQ ID NO: 1263 - DNA, 2946 bp, synthetic construct
  misc_feature 1..2946: note = pGP70 CHIKV sequence
  source 1..2946: mol_type = other DNA
atgtgcctgttggcaaacaccacgttcccctgctcccagcccccttgcacgccctgctgctacgaaaaggaaccggaggaaaccctacgcatgcttgaggacaacgtcatgagacctgggtactatcagctgctacaagcatccttaacatgttctccccaccgccagcgacgcagcaccaaggacaacttcaatgtctataaagccacaagaccatacttagctcactgtcccgactgtggagaagggcactcgtgccatagtcccgtagcactagaacgcatcagaaatgaagcgacagacgggacgctgaaaatccaggtctccttgcaaatcggaataaagacggatgacagccacgattggaccaagctgcgttatatggacaaccacatgccagcagacgcagagagggcggggctatttgtaagaacatcagcaccgtgtacgattactgggacaatgggacacttcatcctggcccgatgtccaaaaggggaaactctgacggtgggattcactgacagtaggaagattagtcactcatgtacgcacccatttcaccacgaccctcctgtgataggtcgggaaaaattccattcccgaccgcagcacggtaaagagctaccttgcagcacgtacgtgcagagcaccgccgcaactaccgaggagatagaggtacacatgcccccagacacccctgatcgcacattaatgtcacaacagtccggcaacgtaaagatcacagtcaatggccagacggtgcggtacaagtgtaattgcggtggctcaaatgaaggactaacaactacagacaaagtgattaataactgcaaggttgatcaatgtcatgccgcggtcaccaatcacaaaaagtggcagtataactcccctctggtcccgcgtaatgctgaacttggggaccgaaaaggaaaaattcacatcccgtttccgctggcaaatgtaacatgcagggtgcctaaagcaaggaaccccaccgtgacgtacgggaaaaaccaagtcatcatgctactgtatcctgaccacccaacactcctgtcctaccggaatatgggagaagaaccaaactatcaagaagagtgggtgatgcataagaaggaagtcgtgctaaccgtgccgactgaagggctcgaggtcacgtggggcaacaacgagccgtataagtattggccgcagttatctacaaacggtacagcccatggccacccgcatgagataattctgtattattatgagctgtaccccactatgactgtagtagttgtgtcagtggccacgttcatactcctgtcgatggtgggtatggcagcggggatgtgcatgtgtgcacgacgcagatgcatcacaccgtatgaactgacaccaggagctaccgtccctttcctgcttagcctaatatgctgcatcagaacagctaaagcggccacataccaagaggctgcgatatacctgtggaacgagcagcaacctttgttttggctacaagcccttattccgctggcagccctgattgttctatgcaactgtctgagactcttaccatgctgctgtaaaacgttggcttttttagccgtaatgagcgtcggtgcccacactgtgagcgcgtacgaacacgtaacagtgatcccgaacacggtgggagtaccgtataagactctagtcaatagacctggctacagccccatggtattggagatggaactactgtcagtcactttggagccaacactatcgcttgattacatcacgtgcgagtacaaaaccgtcatcccgtctccgtacgtgaagtgctgcggtacagcagagtgcaaggacaaaaacctacctgactacagctgtaaggtcttcaccggcgtctacccatttatgtggggcggcgcctactgcttctgcgacgctgaaaacacgcagttgagcgaagcacacgtggagaagtccgaatcatgcaaaacagaatttgcatcagcatacagggctcataccgcatctgcatcagctaagctccgcgtcctttaccaaggaaataacatcactgtaactgcctatgcaaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgtgggtacggtacacgtgccatactctcaggcaccatctggctttaagtattggctaaaagaacgcggggcgtcgctgcagcacacagcaccatttggctgccaaatagcaacaaacccggtaagagcggtgaactgcgccgtagggaacatgcccatctccatcgacataccggaagcggccttcactagggtcgtcgacgcgccctctttaacggacatgtcgtgcgaggtaccagcctgcacccattcctcagactttgggggcgtcgccattattaaatatgcagccagcaagaaaggcaagtgtgcggtgcattcgatgactaacgccgtcactattcgggaagctgagatagaagttgaagggaattctcagctgcaaatctctttctcgacggccttagccagcgccgaattccgcgtacaagtctgttctacacaagtacactgtgcagccgagtgccaccccccgaaggaccacatagtcaactacccggcgtcacataccaccctcggggtccaggacatctccgctacggcgatgtcatgggtgcagaagatcacgggaggtgtgggactggttgttgctgttgccgcactgattctaatcgtggtgctatgcgtgtcgttcagcaggcactaa

SEQ ID NO: 1264 - DNA, 1509 bp, synthetic construct
  misc_feature 1..1509: note = pGP58 Bornavirus BoDV-1 sequence
  source 1..1509: mol_type = other DNA
atgcagctgagcatgagcagcctgatcggcttcggcaccctggtgctggccctgagcgcccagaccttcgacctgcagggcctgagctgcaacaccgacagcacccccggcctgatcgacctggagatcaggaggctgtgccacacccccaccgagaacgtgatcagctgcgaggtgagctacctgaaccacaccaccatcagcctgcccgccgtgcacaccagctgcctgaagtaccactgcaagacctactggggcttcttcggcagctacagcgccgacaggatcatcaacaggtacaccggcaccgtgaagggctgcctgaacaacagcgcccccgaggaccccttcgagtgcaactggttctactgctgcagcgccatcaccaccgagatctgcaggtgcagcatcaccaacgtgaccgtggccgtgcagaccttcccccccttcatgtactgcagcttcgccgactgcagcaccgtgagccagcaggagctggagagcggcaaggccatgctgagcgacggcagcaccctgacctacaccccctacatcctgcagagcgaggtggtgaacaagaccctgaacggcaccatcctgtgcaacagcagcagcaagatcgtgagcttcgacgagttcaggaggagctacagcctggccaacggcagctaccagagcagcagcatcaacgtgacctgcgtgaactacaccagcagctgcaggagcaagctgaggaggaggaggagggacacccagcagatcgagtacctggtgcacaagctgaggcccaccctgaaggacgcctgggaggactgcgagatcctgcagagcctgctgctgggcgtgttcggcaccggcatcgccagcgccagccagttcctgaggggctggctgaaccaccccgacatcatcggctacatcgtgaacggcgtgggcgtggtgtggcagtgccacagggtgaacgtgaccttcatggcctggaacgagagcacctactacccccccgtggactacaacggcaggaagtacttcctgaacgacgagggcaggctgcagaccaacacccccgaggccaggcccggcctgaagagggtgatgtggttcggcaggtacttcctgggcaccgtgggcagcggcgtgaagcccaggaggatcaggtacaacaagaccagccacgactaccacctggaggagttcgaggccagcctgaacatgaccccccagaccagcatcgccagcggccacgagaccgaccccatcaaccacgcctacggcacccaggccgacctgctgccctacaccaggagcagcaacatcaccagcaccgacaccggcagcggctgggtgcacatcggcctgcccagcttcgccttcctgaaccccctgggctggctgagggacctgctggcctgggccgcctggctgggcggcgtgctgtacctgatcagcctgtgcgtgagcctgcccgccagcttcgccaggaggaggaggctgggcaggtggcaggag

SEQ ID NO: 1265 - DNA, 1488 bp, synthetic construct
  misc_feature 1..1488: note = pGP71 TBEV sequence
  source 1..1488: mol_type = other DNA
agcaggtgcacccacctggagaacagggacttcgtgaccggcacccagggcaccaccagggtgaccctggtgctggagctgggcggctgcgtgaccatcaccgccgagggcaagcccagcatggacgtgtggctggacgccatctaccaggagaaccccgcccagaccagggagtactgcctgcacgccaagctgagcgacaccaaggtggccgccaggtgccccaccatgggccccgccaccctggccgaggagcaccagggcggcaccgtgtgcaagagggaccagagcgacaggggctggggcaaccactgcggcctgttcggcaagggcagcatcgtggcctgcgtgaaggccgcctgcgaggccaagaagaaggccaccggccacgtgtacgacgccaacaagatcgtgtacaccgtgaaggtggagccccacaccggcgactacgtggccgccaacgagacccacagcggcaggaagaccgccagcttcaccgtgagcagcgagaagaccatcctgaccatgggcgagtacggcgacgtgagcctgctgtgcagggtggccagcggcgtggacctggcccagaccgtgatcctggagctggacaagaccgtggagcacctgcccaccgcctggcaggtgcacagggactggttcaacgacctggccctgccctggaagcacgagggcgccaggaactggaacaacgccgagaggctggtggagttcggcgccccccacgccgtgaagatggacgtgtacaacctgggcgaccagaccggcgtgctgctgaaggccctggccggcgtgcccgtggcccacatcgagggcaccaagtaccacctgaagagcggccacgtgacctgcgaggtgggcctggagaagctgaagatgaagggcctgacctacaccatgtgcgacaagaccaagttcacctggaagagggcccccaccgacagcggccacgacaccgtggtgatggaggtgaccttcagcggcaccaagccctgcaggatccccgtgagggccgtggcccacggcagccccgacgtgaacgtggccatgctgatcacccccaaccccaccatcgagaacaacggcggcggcttcatcgagatgcagctgccccccggcgacaacatcatctacgtgggcgagctgagctaccagtggttccagaagggcagcagcatcggcagggtgttccagaagaccaagaagggcatcgagaggctgaccgtgatcggcgagcacgcctgggacttcggcagcgccggcggcttcctgagcagcatcggcaaggccctgcacaccgtgctgggcggcgccttcaacagcatcttcggcggcgtgggcttcctgcccaagctgctgctgggcgtggccctggcctggctgggcctgaacatgaggaaccccaccatgagcatgagcttcctgctggccggcgtgctggtgctggccatgaccctgggcgtgggcgcc

SEQ ID NO: 1266 - DNA, 1607 bp, synthetic construct
  misc_feature 1..1607: note = pGP29.3 RABV sequence
  source 1..1607: mol_type = other DNA
acgtgagatcgccaccatggtgcctcaggctctgctgctggtccctatcctgggattcagctcctgcttcggcaagttccccatctacaccatccctgacaccctgggcccttggtccccaatcgacatccaccacctgagctgccccaacaacctggtcgtggaggatgaaggctgtaccaatctgagcggcttcagctacatggaactgaaggtgggatatatcagcgccatcaaggtgaatggcttcacctgcaccggcgtggtgaccgaggccgagacatacacaaacttcgtgggctacgtgaccacaaccttcaagcggaagcacttcagacctacaccagacgcctgtagagccgcctacaactggaagatggccggagatcccagatacgaggaatctctgcacagcccctaccccgactaccactggctgagaaccgtgaagacaaccaaggaatccctggtgattatcagccctagcgtggccgacctggacccttacgacaacagcctacatagcagagtgtttccttctggcaagtgtagcggcatcaccgtgtccagcgtgtactgcagcaccaaccacgactacaccgtttggatgcctgagagcctgcggctggggaccagctgcgacatttttactaatagcagaggaaaacgggcttctaaaggatctaaaacctgtggctttgtggacgagagaggcctgtacaaatctctgaaaggcgcctgcaagctgaagctgtgcggcgttctgggcctcagactgatggacggcacctgggttgctatgcaaacaagcaacgagacaaagtggtgtcctcctgaccagttggtgaacctgcacgatctgcggtctgatgagatcgagcacctggtgatcgaggaactggtcaagaagcgcgaggaatgcctggatgccctggaaagcatcattacaaccaaatcagtgtcttttagacggctgtcctacctgcggaagctggtgcccggcttcggcaaggcctatacaatctttaacaagaccctgatggaagcagaagcccactacaagagcgtgcggacctggaacgaaatcatccctagcaagggctgcctgagggtggggggcagatgccaccctcacgtgaacggcgtgttcttcaacggcatcatcctgggccctgacggccacgtgctgatccctgagatgcagagctctctgctgcagcagcacatcgagctgctcgagagctctgtgatcccactgatgcaccccctggccgatcctttcaccgttttcaaggacggcgacgaaacagaagatttcatcgaggtgcatctgcccgacgtgcacgagcaggtgtctggagtggacctgggcctgcctaattggggcgaatacgtgctgctgagcgctggcacccttatcgccctcatgctgatcatcttcctgatgacctgctgcagaaaggtggatagaccagagagcacccagcggagcctgagaggcaccggaagaaacgtgtccgtgacaagccagagcggcaagttcatccccagctgggagtcttataagagcggaggcgagacaggcctgtgaattcaccccaccagtg

SEQ ID NO: 1267 - DNA, 1607 bp, synthetic construct
  misc_feature 1..1607: note = pGP29.4 RABV sequence
  source 1..1607: mol_type = other DNA
acgtgagatcgccaccatggttcctcaggtgctgctcttcgtgcctctgctggtcttttccatgtgcttcggcaaattccccatctacaccatcccagacaagctgggcccttggagccctatcgacatccaccacctgagctgccctaacaacctcgtggtggaagatgagggctgtacaaacctgtctggcttttcttatatggagctgaaagtgggatacatcagcgccatcaaggtgaacggcttcacctgcaccggcgtggtgacagaggccgagacatacaccaacttcgtgggctacgtgacaaccaccttcaagagaaagcacttccggcctacccctgacgcctgcagagccgcttacaactggaagatggccggcgatcctagatacgaggaaagcctgcataatccttatcctgactaccactggctgagaacagtgaaaaccaccaaggaatccctggtgatcatcagcccctctgtagccgatctggacccctacgacaagagcctgcacagcagagtgttccctagcggaaaatgcagcggtatcaccatctctagcacatactgcagcaccaaccacgactacacgatctggatgcccgagaaccccagactgggcacctcctgcgacatttttacaaatagccggggcaagcgggccagcaagggcggcaagacatgcggcttcgtggacgagagaggcctgtacaaaagcctgaagggcgcctgtaaactgaagctgtgcggagtgcttggcctgcgactgatggacggcacatgggtggccatgcaaacaagcgatgaaaccaagtggtgcccacctgaccagctggtgaacctgcatgatttcagaagcgacgaaatcgagcacctggtggtcgaggaactggtgaagaagcgggaggagtgcctggatgccctggaaagcatcatggctacaaagagcgtgtcatttcgcagactgagccacctgcggaagctggtgcctggcttcggcaaagcctacaccatcttcaacaagaccctgatggaagctgatgcccactacaagtctgtgcggacctggaacgagatcattcccagcaagggatgtctgagagtgggcggaaggtgccacccccacgtgaatggcgtgttcttcaacggcatcatcctgggccccgacggccacgtgctgatcccagagatgcagagcagcctgctgcagcagcacatggaactgctggaatctagcgtgatccctctgatgcaccccctggccgacccttctaccgtgtttaaggacggagatgaggctgaggacttcgtggaagtgcatctccctgacgtgcacaagcagatctctggcgttgatctgggactgcctagctggggcaagtacgtgctggtgtccgcaggcgtgctggtggtcctgatgctgaccattttcatcatgacctgttgtggcagagtgcacagacccaagtccacccagcacggcctgggcggaaccggcagaaaggtgtccgtcaccagccagtctggcaaagtaatcagcagctgggagagctacaagagtggaggcgagacaagactgtgaattcaccccaccagtg

SEQ ID NO: 1268 - DNA, 1607 bp, synthetic construct
  misc_feature 1..1607: note = pGP29.5 RABV sequence
  source 1..1607: mol_type = other DNA
acgtgagatcgccaccatggtgcctcaggtgctgctgttcgtgccactgctgggatttagcctgtgcttcggaaaattcccaatctacaccatccccgataagctggggccttggagccctatcgacatccaccacctgtcatgccccaacaacctggtggtggaagatgagggctgcaccaacctgagcgagttcagctacatggaactgaaagtgggctacatcagcgccatcaaggtgaatggcttcacctgcaccggagtagtgaccgaggccgaaacctacacaaacttcgtgggctacgtcacaaccacattcaagagaaagcacttccggcccacccctgatgcttgtagagccgcttacaactggaagatggccggcgaccctcggtacgaggaaagcctgcacaacccttatcctgactaccactggctgagaacagtgagaaccaccaaagagtctctcatcattatcagccctagcgtgacagacctggatccttacgacaagtccctccattctcgggtgtttccaggcggaaagtgcagcggcatcaccgtgagctctacctactgcagcaccaaccacgactatacaatctggatgcccgagaaccccagacccagaacaccgtgcgacatcttcaccaacagcagagggaaaagagccagcaaaggcaacaaaacctgtggcttcgtggacgaaagaggcctgtataagtccctgaagggagcctgcagactgaagctgtgcggcgtgctgggccttagactgatggacggcacctgggtggccatgcagacaagcgacgagacaaagtggtgtcctcctgaccagctggtcaacctgcatgatttccgcagtgacgagatcgagcacctggtcgtggaagagctggttaagaagcgggaagagtgtctggacgccctggaaagcatcatgaccaccaagagcgtgtccttccggagactgagccacctgagaaagctggtgcccggctttggcaaggcctacaccatctttaacaagaccctgatggaagccgacgcccactacaagagcgtgcggacctggaacgagatcattcccagcaagggctgtctgaaagtgggaggccggtgccaccctcacgtgaatggcgtctttttcaacggcatcatcctgggccctgacggccacgtgctgattcctgagatgcaatctagcctcctgcagcagcacatggaactgctgaagtctagcgtgatccctctgatgcaccccctggccgatccttctaccgtgttcaaggaaggcgatgaggccgaggacttcgtcgaggtgcaccttcctgacgtgtacaagcagatctccggcgtggatctgggactgcctaattggggcaagtacgtgctgatgacagccggagctatgatcggcctggtgctgatcttctccctgatgacctggtgcagacgggctaatagacctgagtccaaacagagaagcttcggcggcacaggcaggaacgtgtctgtgacatctcagagcggcaaggtgatcccaagctgggagagttacaagagcggcggagaaatcagactgtgaattcaccccaccagtg

SEQ ID NO: 1269 - DNA, 1607 bp, synthetic construct
  misc_feature 1..1607: note = pGP29.6 RABV sequence
  source 1..1607: mol_type = other DNA
acgtgagatcgccaccatggtgcctcaggccctgttgtttgtgccactcctggtgttcccactgtgcttcggcaaattccctatctacaccatcctggataagctgggcccatggagccccatcgacatccaccacctgtcttgtcctaacaacctggtggtcgaggatgagggctgcaccaatctgagcggcttcagctacatggagctgaaggtgggctacatcctggccatcaagatgaacggcttcacctgtacaggagtggtgaccgaggccgagacttatacaaacttcgtgggctacgtgacaacaaccttcaagcggaagcacttcagacctacacctgatgcctgtagagccgcttacaactggaaaatggccggcgatccaagatacgaggaatctctccataatccttatcctgattacagatggctgcgcaccgtgaagaccaccaaagagtccctggtcatcatctcccctagcgtggccgacctggacccttacgaccggagcctgcacagcagagtgttcccttccggcaagtgcagcggcgtggccgtgagctccacctactgctctacaaaccacgactacaccatctggatgcctgaaaaccccagactgggaatgagctgcgacatcttcacaaacagccggggcaagcgggcctctaagggcagcgagacctgcggatttgtggacgaaagaggcctgtacaagagcctcaaaggcgcctgcaagctgaagctgtgtggcgtgctgggtctcagactgatggacggcacatgggtggccatgcagaccagcaacgagaccaaatggtgcccccccgaccagctggtgaacctgcacgacttccggagcgacgagatcgagcacctggtggtggaagaactggttagaaagcgggaagagtgcctggacgctctggaaagcatcatgaccaccaagagcgtttcttttcggcggctgagccacctgagaaaactggtgcccggcttcggaaaggcctacaccatcttcaacaagacactgatggaagctgatgcccactacaagtctgtgaggacatggaacgagattctgcctagcaagggatgtctgagagtgggcggaagatgccacccccacgtgaatggcgtgtttttcaacggcatcatcctgggccctgatggcaacgtgctgatccctgagatgcaaagcagcctgctgcagcagcatatggaactgctggaaagctctgttatccccctggtgcatcctctggctgaccccagtaccgtgttcaaggacggcgacgaggctgaggacttcgtggaagtgcacctgcccgatgttcacaaccaggtgtccggcgtcgacctgggcctgcctaattggggcaagtacgtgctgctgagcgccggcgccctgaccgccctgatgctgatcatcttcctgatgacatgctgcagaagggttaacagaagcgagcctacccagcacaacctgcgcgggaccggcagagaggtgtctgtgacacctcagtctggaaagatcattagcagctgggagtcccacaagagcggaggagaaaccagactgtgaattcaccccaccagtg

SEQ ID NO: 1270 - DNA, 1607 bp, synthetic construct
  misc_feature 1..1607: note = pGP29.7 RABV sequence
  source 1..1607: mol_type = other DNA
acgtgagatcgccaccatggtgccccaggcccttctgttcgtgcctctgctggtctttcctctgtgtttcggcaagttccccatctacacaatccctgataagctgggcccttggtcccctatcgacatccaccacctgtcttgccctaacaacctggtcgtggaagatgagggctgtacaaatctgagcggcttcagctacatggaactcaaagtgggctacatcctggctatcaaggtgaacggatttacctgtaccggcgtggtgaccgaggctgaaacctacaccaacttcgtgggatatgtgacaaccacattcaagcggaagcacttccggcctaccccagacgcctgcagagccgcttataactggaagatggccggagatcctagatacgaggaaagcctgcacaacccttaccccgattacagatggctgcgcaccgtgaagaccacaaaggaaagcctggtgatcatttctccttctgtcgccgatctggacccttacgacagaagcctgcacagcagagtgtttcctagcggcaaatgcagcggcgtggccgtgagcagtacatactgcagcaccaaccacgactacaccatttggatgccagagaaccccagactgggcatgagctgcgacatcttcaccaacagccggggaaaacgggcctctaagggcagcgagacatgtggcttcgttgacgagagaggcctgtacaagtcactgaagggcgcctgcaagctgaagctgtgcggcgtcctgggcctaagactgatggacggcacctgggtgtccatgcaaacaagcaacgagaccaagtggtgcccccccgacaagctggtgaatctccatgatttcaggtctgatgagatcgagcacctggtggtcgaggaactggtgcggaaaagagaagagtgcctggatgctcttgagagcatcatgacaaccaagagcgtgtccttcagacggctgagccacctgagaaagctggttcctggcttcggcaaagcctacaccatcttcaacaagaccctgatggaggccgacgcccactacaagtccgtgcggacctggaacgagatcctgccaagcaagggatgtctgcgggtgggcggcagatgccacccccacgtgaacggcgttttcttcaacggcatcatcctgggtcctgacggaaatgtgctgatccccgagatgcagagcagcctgctgcagcagcacatggaactgctggaatcttctgtgatcccactggtgcatcctctggccgaccctagcacagtgtttaaggacggcgacgaggccgaggacttcgtggaagtgcacctgcccgacgtgcacaaccaggtgagcggcgtggacctgggtctgcctaattggggcaaatacgtactgctgagcgccggcgctctgaccgccctgatgctgatcatctttctgatgacctgctgccggagagtgaacagaagcgagcccacccagcacaatctgaggggcacaggaagagaggtgtccgtgacccctcagagcggcaagatcatcagctcttgggaaagccacaagagcggcggagaaaccagactgtgaattcaccccaccagtg

SEQ ID NO: 1271 - DNA, 1607 bp, synthetic construct
  misc_feature 1..1607: note = pGP29.8 RABV sequence
  source 1..1607: mol_type = other DNA
acgtgagatcgccaccatggtgccccaggccctgcttttcgtgccactgctggtgttccctctgtgcttcggcaagttccccatctacacaatccctgataagctgggcccttggtcccctatcgacatccaccacctgagctgtcctaacaacctggtggtggaggacgagggctgcacaaatctgagcggcttcagctacatggagctgaaggtgggctacatcctggctatcaagatgaacggattcacctgcaccggagtggtgaccgaggctgaaaactacaccaatttcgtgggctacgtcaccacgacattcaaaagaaagcacctgcggcccacacctgacgcctgtagggccgcttacaactggaaaatggccggcgaccctagatacgaggaatccctgcacaacccctatcctgattacagctggctgaggaccgtgaagaccaccaaggaaagcctcgtcatcatcagccctagcgtggccgatctggatccttacgacagaagcctccattctcgggtgtttccaagcggcaagtgcagcggcgttgccgtgtctagcacctactgcagcaccaaccacgattacaccatctggatgcctgagaaccctagactgggcaaaagctgcgacatcttcacaaatagcagaggaaaacgggcctctaagggcagcgaaacctgtggctttgtggacgagagaggcctgtacaagagcctgaaaggcgcctgcaagctgaaactctgcggcgtgctgggcctgagactgatggacggcacctgggtggccatgcaaaccagcaacgagacaaagtggtgcccacctgaccagctggtgaacctgcacgacttccggagcgacgagatcgagcacctggtagtggaagagctggtgcggaagcgggaagagtgcctggacgctctggaaagcatcatgaccaccaagtccgtgtcttttagacggctgtcccacctgcggaagctggtccccggcttcggcaaggcctataccatctttaacaagaccctgatggaagccgacgcccactacaagtccgtcagaacctggaacgagatcctgcctagcaagggatgtctgagagtgggcggaagatgccacccccacgtgaacggcgtgttcttcaacggcatcatcctgggccccgatggcaacgtgctgatccccgagatgcagagcagccttctccagcagcacatggaactgctggaaagctctgttattccactggtgcaccctctggccgacccttctacagtgttcaaggacggcgatgaggccgaggacttcgtggaagtgcatctgcctgatgtgcacaaccaggtgtccggagtggacctgggcctgcccaactggggaaaatacgtgctgctgagcgccggagccctgaccgccctgatgctgatcattttcctgatgacctgttgcagaagagtgaatagaagcgagcctacacagcacaatctgcgcggaacaggcagagaagtcagcgtgacacctcagacctggaagatcatctctagttgggagagtcacaagtctggcggcgagacaagactgtgaattcaccccaccagtg

SEQ ID NO: 1272 - DNA, 1607 bp, synthetic construct
  misc_feature 1..1607: note = pGP29.9 RABV sequence
  source 1..1607: mol_type = other DNA
acgtgagatcgccaccatggtcccccaggccctgctgttcgtgccactgctggtgtttcctctctgcttcggaaaattccctatctacaccatccccgataagctgggcccatggagccccatcgacatccaccacctgagctgccccaacaacctggtggtggaggacgagggctgtaccaacctgtccggctttagctacatggaactgaaggtgggctacatcagcgccatcaagatgaacggcttcacatgtacaggcgtggtgaccgaggctgaaacttataccaacttcgtgggctatgtgacaaccacattcaagagaaagcacttccgccccacccctgatgcatgtagagccgcttacaactggaagatggccggcgaccctagatacgaggaaagcctgcataatccttaccccgactaccactggctgagaacagtgaagaccaccaaggaatctctggttatcatctcaccttctgtggctgacctggacccctacgacagatccctgcacagcagagtgttccctggcggcaattgcagcggcgtggccgtgtcttctacatactgcagcacaaaccacgactacaccatctggatgcctgagaaccccagactgggcatgagctgcgacatcttcaccaatagccggggcaagcgggccagcaagggcagcgagacctgtggcttcgtggacgagagaggcctgtacaagagcctgaagggagcctgtaaactgaagctgtgcggcgtgctgggcctgcggctgatggacggcacctgggtggccatgcagaccagcaacgaaaccaagtggtgcccacctggacagctggtgaacctccatgattttcggagcgatgagatcgagcaccttgtggtcgaggaactggtgaaaaagcgggaagagtgcctggatgccctggaaagcatcatgaccaccaaaagcgtgtccttcagaagactgtctcacctgagaaagttggtgcctggctttgggaaggcctacaccatctttaacaagaccctgatggaagccgacgcccactacaagagcgtgaggacctggaacgagatcattccaagcaagggctgcctgagagtgggcggtagatgccaccctcacgtgaacggcgtgttcttcaacggcatcatcctgggccctgatggcaacgtgctgatccctgagatgcaatctagcctgctgcagcagcacatggaactcctggtgtccagcgtgatccctctcatgcaccccctggccgatccttccacagtgttcaagaacggcgatgaagctgaggacttcgttgaggtgcacctgcctgacgtgcacgagcggatcagcggagtggacctgggactgcctaattggggcaaatacgtgctgctgagcgccggcgccctgaccgccctgatgctgatcatcttcctgatgacatgctggcggagagtgaatagaagcgagcctacccagcacaacctgcggggcaccggaagagaagtgtccgttacacctcagagcggcaagatcattagcagctgggagtcctacaaatctggcggagagacaggactgtgaattcaccccaccagtg

SEQ ID NO: 1273 - DNA, 1607 bp, synthetic construct
  misc_feature 1..1607: note = pGP29.1 RABV sequence
  source 1..1607: mol_type = other DNA
acgtgagatcgccaccatggtgcctcaggtgcttctgttcgtgcccctgctgggcttcagcctgtgcttcggaaagttccctatctacaccatccctgatgagctgggaccttggtccccaatcgacatccaccacctcagctgccctaacaacctggtggtggaagatgagggctgcaccaacctgagcgagttcagctacatggagctgaaggtgggatacatctccgccatcaaggtgaacggctttacctgtaccggcgtggtgacagaagctgaaacctacacaaatttcgtgggctacgtgacaacaaccttcaagagaaagcacttccggcccacccctgacgcttgccgggctgcttataactggaagatggccggtgaccccagatacgaggaatccctgcacaacccttatcctgattaccactggctgaggaccgtgcggaccaccaaagagtccctgatcattatcagccctagcgtgaccgacctggacccttacgacaagagcctgcattctagaggctttccaggtggcaagtgcagcggcatcacagtgtctagcacctactgcagcaccaaccacgactacaccatctggatgcctgagaaccccggccctagaaccccgtgcgacatcttcaccaacagcagaggcaaaagggccagcaagggcaacaagacatgcggcttcgtggatgagagaggcctgtacaagtccctgaagggcgcctgtcggctgaagctctgtggcgtgctgggactgcggttgatggacggcacatgggtcgccatgcaaacatctgatgagacaaagtggtgcccccccgaccagctggtcaacctgcacgatttcagatctgacgagatcgagcacctggtggttgaggaactggtgaagaaacgggaagagtgcctggacgccctggaatccatcatgacaacaaagagcgtctccttccgcagactgagccacctgagaaagctggtgcctggctttggcaaggcctacaccatctttaacaagacactgatggaagccgacgcccactacaagtctgtgcgaacctggaacgagattatccccagcaaaggctgtctgaaagttggaggcagatgccacccccacgtgaatggagtctttttcaacggcatcatcctgggccctgacggccacgtgctgatccccgagatgcagtctagcctgctgcagcagcacatggaactgctgaagagcagcgtcatcccactgatgcaccctctggccgacccttcaacagtgttcaaggaaggagatgaagccgaggacttcgtggaagtgcatctgcctgatgtgtacaaacagatcagcggcgtggacctgggcctgccaaattggggcaagtacgtgctgatgaccgccggcgccatgatcggcctggtgctgatcttcagcctgatgacctggtgtagaagagccaatagacctgagtctaagcagagaagcttcggcggcaccggacggaacgtgtccgtgaccagccagagcgggaaagtgatccctagctgggaatcatatagaagcggcggcgagatccggctgtgaattcaccccaccagtg

SEQ ID NO: 1274 - DNA, 1607 bp, synthetic construct
  misc_feature 1..1607: note = pGP29.11 RABV sequence
  source 1..1607: mol_type = other DNA
acgtgagatcgccaccatggtgccccaagccctgctgctggtgcctctgctgggcttttccctgtgcttcggcaagttccccatctacaccatccccaccaaactgggaccttggagccctatcgacatccaccacctgagctgccccaacaacctggtggtggaggatgagggatgcacaaacctgagcggcttcagctacatggaactgaaggtgggaagaatcagcgccatcaaggtcaacggcttcacctgtacaggcgtggtgaccgaggctgaaacatacacaaatttcgtgggatacgtgaccaccacttttaagagaaagcacttcagacctatgcccggctgcatgtacagccgggtgcagctggaagatggtcgctcccctcaaatcgaggaatctctgcacaacccctatcctgattaccactggctgagaaccgtgcggaccacaaaggaatccctgatcattatctctccaagcgtgaccgacctggatccttacgacaagagcctgcacagcagggtgttcccaggcagaaagtgcagcgggatcacagtgagcagcacctactgcagcaccaatcacgattatacagtgtggatgcctgagatcctgcggctgggaacatcttgtgacatctttacaaatagcagaggaaagagagcctctaagggcagcaagacctgcggcttcgtggacgagagaggcctgtacaagtccctgaaaggcgcctgcaagctgaagctctgtggcgtgcctggcctcagactgatggacggcacctgggtcgccatgcagaccagcaacgagacaaagtggtgccctcctggccagctggtgaacctgcacgacctgcatagcgacgaaattgagcacctggtggtggaagagctggtgaagaaaagagaggaatgcctggacgccctggaaagcattaccacaaccaagagcgtctccttccggagactgagccacctgagaaagctggtgcctggctttggaaaggcctacaccatcttcaacaagaccctgatggaagctgaggctcactacaagagcgtgcggacctggaacgagatcatcccatctaaaggctgccttcgggttggcggcggatgtcacccccacgtgaatggcgttttcttcaacggcatcatcctgggccctgatggccacgtgctgatccctgagatgcagtcttctctcctgcagcagcacatcgagctgctggaaagcagcgtgatccccctgatgcaccctctggccgacccattcaccgttttcaaagacggcgacgagatcgaggatttcgtggaagtgcatctgcccgacgtgcacgagcaggtgtctggcgtcgacctgggcctgcctaactggggcgagtacgtgctcctgagcgccggcacactgatcgccctgatgctgatcatctttctgatcacctgctgtaaaagagtggatagacccgagtctacacagcggagcctgagaggcaccggaaggaacgtgtccgtgaccagccagagcggcaagttcatccctagcagagaatcttacaagtccggcggcgagaccggcctgtgaattcaccccaccagtg

SEQ ID NO: 1275 - DNA, 1607 bp, synthetic construct
  misc_feature 1..1607: note = pGP29.12 RABV sequence
  source 1..1607: mol_type = other DNA
acgtgagatcgccaccatggtgccccaggtgctgctgttcgtgttactgctgggattcagcctgtgttttggcaagttcccaatctacaccatccccgacgagctgggcccttggagccctatcgacatccaccacctgtcctgccccaacaacctggtcgtcgaggacgagggctgtaccaacctgagcgagttcagctacatggagctgaaggtgggctacatcagcgccatcaaggtgaatggatttacctgtacaggcgtggtgaccgaggccgagacatacacaaacttcgtgggttatgtgaccaccaccttcaagagaaagcacttcagacctacacctgacgcgtgcagagctgcttacaactggaagatggccggagatcctagatacgaggaatccctgcataatccttatcctgattaccactggctgcggaccgtgcggacaaccaaggaaagcctgatcatcatcagccctagcgttaccgacctggacccctacgacaagagcctgcacagcagagtgttccccggcagaaagtgcagcggcatcaccgtgtccagcacctactgcagcaccaaccacgactacaccatctggatgcctgagaacccccggcctagaacaccgtgcgacatcttcaccaacagcagaggaaaacgcgcttctaacggcaacaagacatgtggcttcgtggacgaaagaggcctgtacaaaagcctcaagggcgcttgtagactgaagctgtgcggcgtgctgggcctgagactgatggacggcacctgggtggccatgcagaccagcggagaaaccaaatggtgcccacctgatcagctggtgaaccttcatgattttagatctgatgagatcgagcacctggtggtggaagagctggtcaagaagcgggaggaatgcctggatgccctggagagcatcatgaccacaaagtctgtctcctttcggagactgagccacctgagaaaactggttcctggcttcggcaaggcctacaccatctttaacaagaccctgatggaagccgacgcccactacaagtccgtgcggacatggaatgagattatcccctctaaaggctgcctgaaagtgggcggaagatgccacccccacgtgaacggtgtgttcttcaacggcctgatcctgggacctgacgaccacgtgctgatcccagaaatgcagagcagcctgctgcagcaacacatggaactgctggaatcttctgtgatccctctgatgcaccctctggccgatccttctacagtgttcaaggaaggcgacgaggccgaggatttcgttgaagtgcacctgcctgacgtgtacaagcagatcagcggcgtggacctgggccttcctaactggggcaaatacgtgctgatgacagccggcgccatgatcggcctggtgctcatcttcagcctgatgacctggtgcaggcgggccaacagacccgagtccaagcagagaagcttcggcggcacaggcggaaatgtgtctgtgacatctcagagcggcaaggtgatcccaagctgggagtcatacaagagcgggggcgagattcggctgtgaattcaccccaccagtg

SEQ ID NO: 1276 - DNA, 1607 bp, synthetic construct
  misc_feature 1..1607: note = pGP29.13 RABV sequence
  source 1..1607: mol_type = other DNA
acgtgagatcgccaccatggtgcctcaggccctgttgttcgtgcccctgctggtgttccccctgtgcttcggcaagttccctatctacaccattccagacaagctgggcccttggtccccaatcgacatccaccacctgcggtgccctaacaacctggtggtcgaggacgagggctgtaccaacctgagcggattcagctacatggaactgaaagtgggctacatcagcgccatcaaggtgaatggcttcacctgtaccggcgtggtgaccgaggccgagacatacaccaacttcgtgggctatgtcacaacaacttttaagagaaagcacttccggcctacccctgatgcttgtagagccgcttacaactggaagatggccggcgaccctagatacgaggaatccctgcacaacccttatcctgattaccactggctgagaaccgtgaagaccacaaaggaaagcctggtgatcatcagccctagcgtggccgatctggatccttacgacaagtccctgcacagcagagtgtttccttctggcaactgcagcggaatcacagtttctagcacatactgcagcaccaaccacgactacaccatctggatgcctgagaaccccagactggaaaccagctgcgacatcttcaccaatagccggggcaagagagcctctaagggcagcaagacatgcggcttcgtggacgagagaggcctgtacaaaagcctgaagggcgcctgcaaactgaaactgtgtggcgtgctgggactgagactgatggacggcacctgggtggccatgcaaacatcagatgaaaccaaatggtgcccacctgaccagctggtgaacctgcatgacttcagaagcgacgaaatcgagcacctggtggtggaagagctggtgaaaaagcgggaagagtgcctggacgccctggaaagcatcatgaccaccaagagcgtctccctgagacggctttctcacctgagaaagctggtccccggctttggcaaggcctacacaatctttaacaagaccctgatggaagctgaggcccactacaagagcgtgcagacctggaacgagatcatccccagcaagggttgtctgagggtgggcggcagatgccacccccacgtgaatggagtgttcttcaatggcatcatcctgggacctgatggccacgtgctgattccagagatgcagagctctctgctccagcagcacatggaattactcgagagcagcgtgatccctctgatgcaccctctggccgacccctctaccgtgtttaaggacggagatgaagccgaggatttcgttgaagtgcacctgcctgacgtgcataagcaggtgtccggagtggacctgggcctgcccaactggggcaagtacgtgctgctgagcgctggcacactgatcgccctgatgctgatcatcttcctgatgacctgctgcagacgcgtgaacagacctaagtccaccgagcggagcctgggcgagacaggccggaaggtgtccgtgaccagccagtctggcaaagtgatcagcagctgggagtcttacaagagcggaggcgagacaagacggtgaattcaccccaccagtg

SEQ ID NO: 1277 - DNA, 1607 bp, synthetic construct
  misc_feature 1..1607: note = pGP29.14 RABV sequence
  source 1..1607: mol_type = other DNA
acgtgagatcgccaccatggtcccccaggtgctgctgttcgcccctctgctggtgtttccactgtgcttcggcaagttccctatctacacaatccctgacaagctcggaccttggtcccctatcgacctgcaccacctgtcctgccccaacaacctggtggtcgaggacgaaggctgtaccaatctgagcggattcagctacatggagctgaaggtgggctacatcagcgccatcaaggtgaacggcttcacatgtacaggcgtggtgacagaggccgaaacatacaccaacttcgtgggctatgtgaccacaacattcaaaagaaagcacttcagaccgacccctgatgcctgcagagccgcttacaactggaagatggccggcgatcctagatacgaggagtctctgcataatccttatcctgattaccactggctgcggaccgtgaagacaaccaaggaatctctggtgatcatttctccttctgtgacagacctggatccttacgacaagagcctgcacagcagagtcttccccggcggcaactgcagcggcatcaccgtgtccagcacatactgcagcaccaaccacgactacaccatctggatgcctgagaacctgcggctgggcactagctgcgacatctttacccactctagaggcaaacgggccagcaagggagataagacctgtggctttgtggatgaacggggcctgtacaaatccctgaagggagcctgtaaactgaaactgtgcggcgtgctgggtctgcgcctgatggacgggacctgggtggccatgcaaaccagcgacgagacaaagtggtgccctcctggccagctggtcaacctccatgatttcagaagcgacgagatcgagcacctggtggaagaggagcttgttaagaagagagaagagtgcctggacgctctggaatccatcatgaccacaaaaagcgtgtcttttcggcggctgagccacctgaggaagctggtgcccggcttcggcaaggcctacaccatcttcaacaagaccctgatggaagctgatgcccactacaaaagcgtgcagacctggaacgagatcatcccttctaagggatgtctgcgagtgggcgagcggtgccaccctcacgtgaatggcgttttcttcaacggcatcatcctgggatctgacggccacgtgctgattccagagatgcagagcagcctgctgcaacagcacatggagctgctggaaagcagcgtgatccccctgatgcaccccctggccgaccccagcaccgtgttcaaggacggcgacgaggtggaagattttgtggaagtccacttgcctgacgtgcacaagcaggtgtccggcgtggacctgggcctacccaagtggggaaagtacgtgctgatgatcgctggcgccctgatcgccctgatgctgattatcttcctgatgacctgctgcagaagagtgaacagacctgagagcacccagtctaatctgggtggcaccggcagaaacgtgtccgtgcctagccagagcggcaaggtgatcagcagctgggagagctacaagagcggcggagaaaccagactgtgaattcaccccaccagtg

SEQ ID NO: 1278 - DNA, 1607 bp, synthetic construct
  misc_feature 1..1607: note = pGP29.15 RABV sequence
  source 1..1607: mol_type = other DNA
acgtgagatcgccaccatgatcccacaggccctgctgttcgtgcccctgctgatccccagcctgtgtctgggcaaattccccatctacaccattcctgataagctgggcccttggagccctatcgacatccaccacctgagctgccccaacaacctggtggtcgaggacgagggctgtactagcctgtccggatttagctacatggagctgaaggtgggctacatcagcgccatgaaagtgaacggattcacctgcaccggcgtggtgaccgaggccgagacatacaccaacttcgtcggatacgtcacaacaacattcaagcggaagcacttcagacctatgccagacgcctgcagagctgctcacgactggaagatcgccggcgatccacggtacgaggacagcctgcaaaatccttatcctgattaccactggctgaggacagtgaagaccaccaaggaaagcctagtgatcatcagtccttctgtggctgatctggatccttacgacaagagcctgcattctagagtgtttcctagcggcaagtgcctgggtatcaccgtgtctagcacctactgccctacaaatcacgattacactatctggatgcctgtggaagccagactgggaacaagttgcgacatctttaccaacagccggggcaagaaggccagcaaaggcggaagaacctgtggctttgtggacgaaagaggcctttataagagcctgaagggcgcctgtaaactgaagttgtgcggagttcctggcctgagactgatgaacggcacatgggtgtccatccagaccagcgacgacatcaagtggtgccctcccgatcagctggttaatctgcacgacttccactctgacgagatcgagcacctggtggtggaggaactgatcaagaaaagagaaggatgtctcgatgccctggaaagcatcatgaccacaaagtccgtctccttccggcgcctgagccacctgagaaagctggtccccggcttcggcaaagcctacaccatcttcaacaacaccctgatggaagccgacgcgcactacaagtctgttagaacctggaacgaggtgatcccttctaaaggctgcctgaaggtgggaggcagatgccaccctcctgtgaacggcgtgttcttcaacggcatcatcctgggcccagacggcaacgtgctgatccctgagatgcagagctctctgctgcagcagcacatggaactgctcgaaagcagcgtgatccccctgatgcaccccctggctgacccctccaccgtgttcaaggacggcgacgaggctgaagatttcgtggaagtgcacctgcccgacgtgcataagcaggtgtccgacgtggacctgggcctgcctagctggggcaagtacctgctcatgagcgccggagccctggccaccctgattctggccatcttcctgattacatgctgcagacgggccaatcggaccaagtctacccagcggggccacagagagagcggcggcaaggtgagcgtggcccctcaaaacggcaaaatcatcagcagctgggagctgtacaagagcgagagcgagacaggcatgtgaattcaccccaccagtg

SEQ ID NO: 1279 - DNA, 1575 bp, synthetic construct
  misc_feature 1..1575: note = pGP29.2 codon optimized RABV sequence
  source 1..1575: mol_type = other DNA
atggtgccccaggccctgctcttcgtgcctctgctcgtctttccactgtgcttcggcaaatttcccatctacactattcctgacaagctgggaccctggagtcctatcgatattcaccatctgtcatgccctaacaatctcgtggtcgaggatgaagggtgtaccaacctgtcaggtttcagctacatggagctgaaagtggggtatatcctcgctattaaggtcaacggcttcacatgcactggagtggtcaccgaggcagaaacctacacaaattttgtgggctatgtcaccacaactttcaagaggaaacactttagaccaacacccgacgcctgtcgcgccgcttacaactggaagatggctggcgatccacgatatgaggaatctctgcacaatccttacccagactatagatggctgcggacagtgaagaccacaaaagagagcctggtcatcattagcccatccgtcgcagacctggatccctacgatagatccctgcactctcgggtgtttccctctggcaagtgcagtggagtggccgtcagctccacttactgtagcaccaaccatgattatactatctggatgccagagaatccccggctgggaatgtcctgcgacattttcacatctagtcgcgggaagcgagccagtaaagggtcagagacttgtggttttgtggacgaaaggggcctgtataagagcctcaaaggagcttgcaagctgaaactctgtggcgtgctgggactcagactgatggatggaacctgggtctcaatgcagacaagcaacgagactaagtggtgcccccctgacaaactcgtgaatctgcacgacttcaggtccgatgagatcgaacatctggtggtcgaggaactcgtgcgaaaaagggaggaatgtctcgatgctctggagtctatcatgactaccaagtctgtgagttttaggagactcagtcacctgagaaagctcgtccctggcttcggaaaagcatacaccatctttaacaagacactgatggaagcagacgcccattataaaagcgtggagacctggaatgaaatcctgccatccaagggatgcctccgagtcggaggacgctgtcaccctcatgtgaacggcgtcttctttaatggaatcattctggggcctgacggtaacgtgctgatcccagagatgcagtcaagcctgctccagcagcacatggagctgctcgaatcctctgtgattcctctggtccatccactcgcagatccctctacagtgttcaaggacggggatgaggccgaagactttgtggaggtccacctgccagatgtgcataaccaggtgtctggggtcgacctcggtctgcccaattgggggaagtacgtgctgctcagcgccggtgcactgactgctctcatgctgatcattttcctgatgacctgctgtcgacgagtgaaccggtccgagcctactcagcacaatctgcgagggaccggtagagaagtgtccgtcacaccacagtctggcaaaatcattagttcatgggagagccataagtccgggggtgaaacacgcctgtga

SEQ ID NO: 1280 - DNA, 1575 bp, synthetic construct; identical to SEQ ID NO: 1004
  misc_feature 1..1575: note = pGP29 RABV sequence
  source 1..1575: mol_type = other DNA

SEQ ID NO: 1281 - DNA, 1569 bp, synthetic construct
  misc_feature 1..1569: note = pGP30 Mokola virus sequence
  source 1..1569: mol_type = other DNA
atgaatataccttgctttgttgtgattctcagcttagccactacacattctctgggagaattccccttgtacacaattcctgagaagatagagaaatggactcccatagacatgatccatctgagttgccccaacaacctattatctgaggaagaaggttgcaatgcagagtcatcctttacttactttgagctcaagagtggttacctagctcatcagaaggttccagggtttacctgtaccggggtcgtgaacgaggcagagacatatacaaacttcgtcgggtacgtcaccacaaccttcaaaaggaagcactttaggcctacagtagccgcctgtcgtgatgcctacaactggaaagtgtcaggagaccccaggtacgaagagtcactccacactccttatcctgacagcagttggttgaggactgtgactacaaccaaagaatcacttctcataatatcgcccagcatcgtggaaatggatatttacggcaggactctccattcccccatgtttccttcaggagtatgttccaacgtatatccctctgtcccatcctgtgagactaatcatgattacacattatggctgcctgaagatcctagtttgagtttggtctgtgatatctttacttccagcaacggaaagaaggccatgaacgggtcacgcatctgcggattcaaggatgaaaggggattctacagatctttaaagggcgcttgcaagctgacattgtgtggaagacctggaattaggttattcgacggaacttgggtctcttttacaaagccggacgtgcacgtatggtgcactcccaaccaattgatcaatatacacaatgacagactagatgagatagaacacctgatcgtggaagacatcataaagaaaagagaagagtgcttagacaccctggaaacaatacttatgtctcaatctgttagctttagaaggttgagccatttccgaaagttagttccaggatatgggaaggcctacactattttaaacggcagcctgatggaaacaaatgtctactacaaaagggtcgacaagtgggctgacatcttaccctctaagggatgtctgaaagtcgggcaacaatgcatggaacctgtcaaaggagtcctcttcaatgggattatcaagggcccggatggccaaattttgatccccgagatgcagtcagagcagctaaagcagcatatggacctgttgaaggcggctgtgtttcctctccgacaccctttaatcagccgggaggcagtctttaagaaagacggggatgccgatgattttgtggatctccatatgcctgatgtccacaagtctgtgtcagatgtcgacctgggtctgcctcattggggtttctggatgttgatcggggcaacaatagtagcatttgtggtcttggtatgtttactccgtgtatgttgtaagagagtgaggaggagaagatcaggacgtgcaactcaggagatccccctgagctttccctctgcccctgttcctcgagccaaagtggtgtcatcttgggagtcctataaagggcttccaggtacatga

SEQ ID NO: 1282 - DNA, 1653 bp, synthetic construct
  misc_feature 1..1653: note = pGP32.1 Measles virus sequence
  source 1..1653: mol_type = other DNA
atggggcttaaggccagtgtctcagcgatattcatgacggtgctccttacgctccagacccctactgggcagatccattggggcaacctgtcaaaaataggtgtcgtagggatcggctccgcatcatataaggtgatgacgcggtccagtcaccagagcttggtgattaagttgatgcctaacatcactcttctgaataattgtacgcgggtggaaatcgcggagtatcgcagactcttgcgcacggtactcgagcctattagggatgcgcttaacgcaatgacgcagaacatcaggcctgtacaatcagtagcatccagcaggaggcataaacgattcgcgggggttgtcctcgcgggggctgctctcggtgttgccaccgctgcccaaattacggcgggtatagcgctccatcaatcaatgctgaatagccaggcgatagataacctgagagcgtccttggagacaactaatcaggcaatcgaaaccattagacaagccggacaggaaatgattttggccgtccagggaattcaagattacatcaataatgaattgattccttcaatgaaccaattgagttgtgatctgattggccaaaaactcggtttgaaattgctgaggtactacacggagatcctctctctttttggcccatccctccgcgatccaatttcagcagaaatctcaatccaagctctgagttatgctctcggcggcgatatcaacaaagtccttgaaaagctcggttatagtggtggggacctgttgggcatactcgagtcccgagggatcaaagcgcgaattactcacgtcgacactgaaagttacttcatcgttctgtctattgcttatcccacgttgagtgaaatcaagggagttatagtccaccgcttggagggcgtttcatataatattggttcccaagagtggtacacgacagtgccaaaatacgttgcgacccagggctatctcatcagcaactttgacgagtcatcttgtactttcatgccagaaggaacagtttgttcacagaatgccctgtatcctatgagcccgttgctccaagaatgtctcaggggatctactaaatcatgtgcgaggactcttgtaagcgggtcctttggaaatcggtttattcttagtcaaggaaatctcatagcgaactgtgcgagtattttgtgtaaatgttacacgaccggtacgatcataaatcaagacccagacaagattctgacctatattgctgcagactattgccccgtggtagaggtaaatggggtgactatacaggttgggtcacgcaaatatcccgatgccgtgtacttgcacaggatagatttgggccctcctattagcctcgaacgcctggacgtagggacgaacctgggaaatgcggtcgctaagctcgaagacgcaaaagagctgctcgaatcatccgatcagatactgcggagtatgaagggtctgagttccacaaacattgtttacattcttattgccgtttgcttggggggtctgattggcatacccactttgatttgttgttgccgaggtcgctgcaacaaaaaaggggggcaggtcggcatgagtcgaccgggccttaagccagacttgacaggtacgagtaaaagttacgttcgctccctttag

SEQ ID NO: 1283 - DNA, 1854 bp, synthetic construct
  misc_feature 1..1854: note = pGP32.2 Measles virus sequence
  source 1..1854: mol_type = other DNA
atgtcaccacaacgagaccggataaatgccttctacaaagataacccccatcccaagggaagtaggatagttattaatagagaacatcttatgattgatagaccttatgttttgctggctgttctattcgtcatgtttctgagcttgatcgggttgctagccattgcaggcatcagacttcatcgggcagccatctacaccgcagagatccataaaagcctcagcaccaatctagatgtaactaactcaatcgagcatcaggtcaaggacgtgctgacaccactcttcaaaatcatcggtgatgaagtgggcctgagaacacctcagagattcactgacctagtgaaattcatctctgacaagattaaattcctcaatccggatagggagtacgacttcagagatctcacttggtgtatcaacccgccagagagaatcaaattggactatgatcaatactgtgcagatgtggctgctgaagagctcatgaatgcattggtgaactcaactctactggagactaggacaaccaatcagttcctagctgtctcaaagggaaactgctcagggcccactacaatcagaggtcaattctcaaacatgtcgttgtccctgttggacttgtatttgagtcgaggttacaatgtgtcatctatagtcactatgacatcccagggaatgtacgggggaacttacctagtggaaaagcctaatctgagcagcaaagggtcagagttgccacaaccaagcatgcaccgagtgtttgaagtaggtgtcatcagaaatccgggtttgggggctccggtgttccatatgacaaactattttgagcagccagtcagcaatgatttcagcaactgtatggtggctttgggggagctcaaactcgcagctctttgccacggggaagattctatcacaattccctatcagggatcagggaaaggtgtcagcttccagctcgtcaagctaggtgtctggaaatccccaaccgacatgcaatcctgggtccccttatcaacggatgatccagtgatagacaggctttacctctcatctcacagaggtattatcgctgacaatcaagcaaaatgggctgtcccgacaacacgaacagatgacaagttgcgaatggagacatgcttccagcaggcgtgtaagggtaaaatccaagcactctgcgagaatcccgagtgggcaccattgaaggataacaggattccttcatacggggtcttgtctgttgatctgagcctggcagttgagcttaaaatcaaaattgcttcaggattcgggccattgatcacacacggttcagggatggacctatacaaatccaaccacaacaatgtgtattggctgactatcccgccaatgaagaacctagccttaggtgtaatcaacacattggagtggataccgagattcaaggttagtcccaacctctttactgtcccaattaaggaagcaggcgaggactgccatgccccgacatacctacctgcggaggtggatggtgatgtcaaactcagttccaatctggtgattctacctggtcaagatctccaatatgttttggcaacctacgatacttccagggttgaacatgctgtggtttattacgtttacagcccaagccgctcattttcttacttttatccttttaggttgcctataaagggagtccccatcgaattacaagtggaatgcttcacatgggaccaaaaactctggtgccgtcacttctgtgtgcttgcagactcagaatctggtggacatatcactcactctgggatggtgggtatgggagtcagctgcacagtcactcgggaagatggaaccaaccgcggatag

SEQ ID NO: 1284 - DNA, 1467 bp, synthetic construct
  misc_feature 1..1467: note = pGP6 Mouse mammary tumor virus sequence
  source 1..1467: mol_type = other DNA
atgggtaagtttctcgccactttgattttattcttccagttctgccccctcatcttcggtgattacagccccagctgctgtactctcacaattggagtctcctcataccactctaaaccctgcaatcctgcccagccagtttgttcgtggaccctcgacctgctggccctttcagcagatcaggccctacagcccccctgccctaacctagtaagttactccagctaccatgccacctattccctatatctattccctcattggactaagaagccaaaccgaaatggcggaggctattattcagcctcttattcagacccttgttccttaaagtgcccatacctggggtgccaatcatggacctgcccctatacaggagccgtctccagcccctactggaagtttcaacacgatgtcaattttactcaagaagtttcacgcctcaatattaatctccatttttcaaaatgcggttttcccttctcccttctagtcgacgctccaggatatgaccccatctggttccttaataccgaacccagccaactgcctcccaccgcccctcctctactcccccactctaacctagaccacatcctcgagccctctataccatggaaatcaaaactcctgacccttgtccagttaaccctacaaagcactaattatacttgcattgtctgtatcgatcgtgccagcctctccacttggcacgtcctatactctcccaacgtctctgttccatcctcttcttctacccccctcctttacccatcgttagcgcttccagccccccacctgacgttaccatttaactggacccactgctttgacccccagattcaagctatagtctcctccccctgtcataactccctcatcctgccccccttttccttgtcacctgttcccaccctaggatcccgctcccgccgagcggtaccggtggcggtctggcttgtctccgccctggccatgggagccggagtggctggcgggattaccggctccatgtccctcgcctcaggaaagagcctcctacatgaggtggacaaagatatttcccagttaactcaagcaatagtcaaaaaccacaaaaatctactcaaaattgcgcagtatgctgcccagaacagacgaggccttgatctcctgttctgggagcaaggaggattatgcaaagcattacaagaacagtgccgttttccgaatattaccaattcccatgtcccaatactacaagaaagacccccccttgagaatcgagtcctgactggctggggccttaactgggaccttggcctctcacagtgggctcgagaggccttacaaactggaatcacccttgttgcgctactccttcttgttatccttgcaggaccatgcatcctccgtcagctacgacacctcccctcgcgcgtcagatacccccattactctcttataaaacctgagtcatccctgtaa

SEQ ID NO: 1285 - DNA, 1467 bp, synthetic construct; identical to SEQ ID NO: 1284
  misc_feature 1..1467: note = pGP7 Human T-lymphotrophic virus 1 sequence
  source 1..1467: mol_type = other DNA

SEQ ID NO: 1286 - DNA, 1698 bp, synthetic construct
  misc_feature 1..1698: note = pGP8 RD114 Endogenous feline retrovirus sequence
  source 1..1698: mol_type = other DNA
atgaaactcccaacaggaatggtcattttatgtagcctaataatagttcgggcagggtttgacgacccccgcaaggctatcgcattagtacaaaaacaacatggtaaaccatgcgaatgcagcggagggcaggtatccgaggccccaccgaactccatccaacaggtaacttgcccaggcaagacggcctacttaatgaccaaccaaaaatggaaatgcagagtcactccaaaaaatctcacccctagcgggggagaactccagaactgcccctgtaacactttccaggactcgatgcacagttcttgttatactgaataccggcaatgcagggcgaataataagacatactacacggccaccttgcttaaaatacggtctgggagcctcaacgaggtacagatattacaaaaccccaatcagctcctacagtccccttgtaggggctctataaatcagcccgtttgctggagtgccacagcccccatccatatctccgatggtggaggacccctcgatactaagagagtgtggacagtccaaaaaaggctagaacaaattcataaggctatgcatcctgaacttcaataccaccccttagccctgcccaaagtcagagatgaccttagccttgatgcacggacttttgatatcctgaataccacttttaggttactccagatgtccaattttagccttgcccaagattgttggctctgtttaaaactaggtacccctacccctcttgcgatacccactccctctttaacctactccctagcagactccctagcgaatgcctcctgtcagattatacctcccctcttggttcaaccgatgcagttctccaactcgtcctgtttatcttcccctttcattaacgatacggaacaaatagacttaggtgcagtcacctttactaactgcacctctgtagccaatgtcagtagtcctttatgtgccctaaacgggtcagtcttcctctgtggaaataacatggcatacacctatttaccccaaaactggacaggactttgcgtccaagcctccctcctccccgacattgacatcatcccgggggatgagccagtccccattcctgccattgatcattatatacatagacctaaacgagctgtacagttcatccctttactagctggactgggaatcaccgcagcattcaccaccggagctacaggcctaggtgtctccgtcacccagtatacaaaattatcccatcagttaatatctgatgtccaagtcttatccggtaccatacaagatttacaagaccaggtagactcgttagctgaagtagttctccaaaataggaggggactggacctactaacggcagaacaaggaggaatttgtttagccttacaagaaaaatgctgtttttatgctaacaagtcaggaattgtgagaaacaaaataagaaccctacaagaagaattacaaaaacgcagggaaagcctggcatccaaccctctctggaccgggctgcagggctttcttccgtacctcctacctctcctgggacccctactcaccctcctactcatactaaccattgggccatgcgttttcagtcgcctcatggccttcattaatgatagacttaatgttgtacatgccatggtgctggcccagcaataccaagcactcaaagctgaggaagaagctcaggattga

SEQ ID NO: 1287 - DNA, 2058 bp, synthetic construct
  misc_feature 1..2058: note = pGP9 gibbon ape leukemia virus sequence
  source 1..2058: mol_type = other DNA
atggtattgctgcctgggtccatgcttctcacctcaagcctgcaccaccttcggcaccagatgagtcctgggagttggaaaagactgatcatcctcttaagctgcgtattcggcggcggcggaacgagtctgcaaaataagaacccccaccagcctatgaccctcacctggcaggtactgtcccaaactggagacgttgtctgggatacaaaggcagtccagcccccttggacttggtggcccacacttaaacctgatatatgtgccttggcggctggtcttgagtcctgggatatcccgggaaccgatgtctcgtcctctaaacgagtcagacctccggactcagactatactgccgcttataaacaaatcacctggggagccatagggtgcagctaccctcgggctaggaccagaatggcaagctccaccttctacgtatgtccccgggatggccggaccccttcagaagctagaaggtgcggggggctagaatccctatactgtaaagaatggaattgtgaaaccacagggaccggttattggctacccaagtcctcaaaagacctcataacgggtagatgggatcaaaatagcaaatgggatcaaaaatttcaaaagtgtcaccagaccggctggtgtaacccccttaaaatagatttcacagacacaggaaaatcctccagggattggatagtaggaaaaacctggggattaagattctatgtgcatggacatccaggcgtccagttcaccattcgcttaaaaatcaccagcatgacagctgtggcagtcggccccgatcccgtccttgtggaacaaggacctcccagaagggccctcgctctcccacctcctctccccccaagggaagcgccaccgccacctctccccgactccaactccacaaccctggcgactagtgcacaaactcccacggtgggaaaaacaattgttaccctaaacactccgcctcccaccacaggcgacagactctttaacctcgtgcagggggccttcctaaccctgaatgctaccaacccaggggccactaagtcatgctggctttgtttggccatgggtcccccctattatgaagcaataacctcattgggggaggtcgcttattccaccagccaggaccggtgccactggggaacccaaggaaagcttaccctcactgaggtctcaggacacgggttatgcataggaaaggtgcccttcacccatcagcatctctgcaatcagaccctatccatcaattcctccgagggccatcagtatctgctcccctccaatcatagctggtgggcttgcagcactggcctcaccccttgcctctctacctcagtttttaatcagagtcgagatttctgtatccaggtccagctgatccctcgcatctattactatcctgaagaagttttgttacaggcctatgacgattctcaccccaggcctaaaagagaagctgtctcacttaccctagctgttttactggggttggggatcacggcgggtataggtactggttcaaccgccttaattaaaggacccatagacctccaacaaggcctgaccagcctccagatcgccatagatgctgacctccgggccctccaggactcagtcagcaagctggaggactcactgacctccctgtccgaggtagtactccaaaataggagaggccttgacttgctgtttctaaaggaaggaggcctctgtgcggccctaaaagaagagtgctgtttttatatagaccactcaggtgcagtacgagactccatgaaaaaactcaaagaaaaactagataaaagacagttagagcgccagaaaaaccaaaactggtatgaagggtggttcaataactccccttggttcactaccctactatcaaccattgccgggcccctgttactcctccttctattgctcatcctcgggccctgcatcatcaataagttagttcaattcatcaatgatagagtaagtgcagttaaaattttggtccttaggacaaaatatcaggccctagataacgaagataacctttaa

SEQ ID NO: 1288 - DNA, 1998 bp, synthetic construct
  misc_feature 1..1998: note = pGP10 Moloney murine leukemia virus sequence
  source 1..1998: mol_type = other DNA
atggcgcgttcaacgctctcaaaaccccttaaaaataaggttaacccgcgaggccccctaatccccttaattcttctgatgctcagaggggtcagtactgcttcgcccggctccagtcctcatcaagtctataatatcacctgggaggtaaccaatggagatcgggagacggtatgggcaacttctggcaaccaccctctgtggacctggtggcctgaccttaccccagatttatgtatgttagcccaccatggaccatcttattgggggctagaatatcaatcccctttttcttctcccccggggcccccttgttgctcagggggcagcagcccaggctgttccagagactgcgaagaacctttaacctccctcacccctcggtgcaacactgcctggaacagactcaagctagaccagacaactcataaatcaaatgagggattttatgtttgccccgggccccaccgcccccgagaatccaagtcatgtgggggtccagactccttctactgtgcctattggggctgtgagacaaccggtagagcttactggaagccctcctcatcatgggatttcatcacagtaaacaacaatctcacctctgaccaggctgtccaggtatgcaaagataataagtggtgcaaccccttagttattcggtttacagacgccgggagacgggttacttcctggaccacaggacattactggggcttacgtttgtatgtctccggacaagatccagggcttacatttgggatccgactcagataccaaaatctaggaccccgcgtcccaatagggccaaaccccgttctggcagaccaacagccactctccaagcccaaacctgttaagtcgccttcagtcaccaaaccacccagtgggactcctctctcccctacccaacttccaccggcgggaacggaaaataggctgctaaacttagtagacggagcctaccaagccctcaacctcaccagtcctgacaaaacccaagagtgctggttgtgtctagtagcgggacccccctactacgaaggggttgccgtcctgggtacctactccaaccatacctctgctccagccaactgctccgtggcctcccaacacaagttgaccctgtccgaagtgaccggacagggactctgcataggagcagttcccaaaacacatcaggccctatgtaataccacccagacaagcagtcgagggtcctattatctagttgcccctacaggtaccatgtgggcttgtagtaccgggcttactccatgcatctccaccaccatactgaaccttaccactgattattgtgttcttgtcgaactctggccaagagtcacctatcattcccccagctatgtttacggcctgtttgagagatccaaccgacacaaaagagaaccggtgtcgttaaccctggccctattattgggtggactaaccatggggggaattgccgctggaataggaacagggactactgctctaatggccactcagcaattccagcagctccaagccgcagtacaggatgatctcagggaggttgaaaaatcaatctctaacctagaaaagtctctcacttccctgtctgaagttgtcctacagaatcgaaggggcctagacttgttatttctaaaagaaggagggctgtgtgctgctctaaaagaagaatgttgcttctatgcggaccacacaggactagtgagagacagcatggccaaattgagagagaggcttaatcagagacagaaactgtttgagtcaactcaaggatggtttgagggactgtttaacagatccccttggtttaccaccttgatatctaccattatgggacccctcattgtactcctaatgattttgctcttcggaccctgcattcttaatcgattagtccaatttgttaaagacaggatatcagtggtccaggctctagttttgactcaacaatatcaccagctgaagcctatagagtacgagccatag

SEQ ID NO: 1289 - DNA, 1692 bp, synthetic construct
  misc_feature 1..1692: note = pGP11 Baboon endogenous virus sequence
  source 1..1692: mol_type = other DNA
atgggattcacaacaaagataatcttcttatacaacctagtactggtctacgcggggtttgacgaccctcgcaaagccatagaactagtacaaaagcgatatggccgaccatgcgattgcagcggaggacaagtgtccgagcccccgtcagacagggtcagtcaagtgacttgctcaggcaagacagcttacttaatgcccgaccaaagatggaaatgtaagtcaattccaaaagacacctccccaagcgggccactccaagagtgcccctgtaattcttaccagtcctcagtacacagttcttgttatacctcataccaacaatgcagatcaggcaataagacatattatacggctactctgctaaaaacacaaactgggggcaccagtgatgtacaagtattaggatccaccaacaaacttatacaatctccctgtaatggcataaaagggcagtctatttgctggagcactacagctcctatccacgtctctgatggaggaggtccattagacaccacaagaattaaaagtgttcagagaaaactggaagaaattcataaagccctatatcctgaacttcagtatcaccctttggccatacctaaggttagagataacctcatggtcgatgcccagactttaaacattctcaatgccacttacaacttactcctaatgtccaacacgagcctagtggacgactgttggctttgtttaaaattaggtccccctactcccctcgcaatacctaacttcctattatcctacgtgactcgctcctcggataatatctcttgtttaataattcccccccttctagttcaaccgatgcagttttccaattcatcttgcctcttttccccctcctacaacagtacagaagaaatagatctaggccatgttgccttcagcaactgtacctccataaccaatgtcaccggtcccatatgcgctgtaaatggttcggtctttctctgtggcaataacatggcatacacttatctacccacgaactggacggggctttgcgtcctagcaactctcctccccgacattgacatcattcccggagatgaaccggtccccatccctgctattgatcattttatatatagacctaaacgggccatacagtttattcctttactagcagggctagggatcaccgcagccttcacaacaggagctacaggcctaggtgtctctgtgacccaatatacaaaattatctaatcagctaatttctgatgtacaaatcttatctagcaccatacaagatctgcaagatcaagtagactcattagccgaagtggttctccagaacagaagggggctagatctacttacagcagaacaaggaggaatctgtttagccctgcaagaaaaatgctgcttttatgttaacaagtcagggattgtgagagacaaaataaaaaccttacaagaagaactagaaagacgtagaaaagatctagcttccaacccactttggactgggcttcaagggctcctcccttacctcctgccctttcttggccctctacttaccctcctgctcttactcaccattgggccgtgcatttttaaccgtctaaccgcttttattaatgataagttaaacataatacacgctatggtgctaacccaacagtatcaggtgctcagaaccgatgaagaagctcaagattga

SEQ ID NO: 1290 - DNA, 2958 bp, synthetic construct
  misc_feature 1..2958: note = pGP12 Human foamy virus sequence
  source 1..2958: mol_type = other DNA
atgacactgcaacaatggatcatttggaaaaaaatgaataaagcgcatgaggcacttcaaaatacaacaactgtgactgaacagcagaaggaacaaattatactggacattcaaaatgaagaagtacaaccaactaggagagataaatttagatatctgctttatacttgttgtgctactagctcaagagtattggcctggatgtttttagtttgtatattgttaatcattgttttggtttcatgctttgtgactatatccagaatacaatggaataaggatattcaggtattaggacctgtaatagactggaatgttactcaaagagctgtttatcaacccttacagactagaaggattgcacgttcccttagaatgcagcatcctgttccaaaatatgtggaggtaaatatgactagtattccacaaggtgtatactatgaaccccatccggaacccatagtggtgaaggagagggtcctaggtctttctcaaattctgatgattaattcagaaaacattgctaataatgctaatttgacacaagaagtaaagaagttgttaactgaaatggttaatgaagaaatgcaaagtttgtcagatgtaatgattgactttgaaattcctttaggagaccctcgtgatcaagaacaatatatacatagaaaatgctatcaagaatttgcaaattgttatttagtaaaatataaagaacccaaaccgtggcctaaggagggccttatagctgatcaatgcccattaccaggttaccatgctggattaacctataatagacagtctatttgggattactatattaaagtggagagtattagacctgcaaattggacaacaaagagtaaatatggacaagctagactaggaagtttttatattcctagcagcctgagacaaatcaatgttagtcatgtactattctgtagtgatcaattatattctaaatggtataatatagaaaataccatagaacaaaacgagcggtttctgcttaataaactaaataaccttacatctggaacctcagtattgaagaaaagagctcttccgaaggattggagttctcaaggtaaaaatgctctgtttagagaaatcaatgtgttagatatctgcagtaaacctgaatctgtaatactattgaatacttcatactattccttctctttatgggaaggagattgtaattttactaaagatatgatttctcagttggttccagaatgtgatggattttataacaattctaagtggatgcatatgcatccatatgcttgtagattctggagaagtaagaagaatgaaaaagaagaaactaaatgtagagatggggaaactaagagatgtctgtattatcctttatgggacagtcccgaatctacatatgattttggttatttagcataccaaaagaattttccttcccctatctgtatagaacaacagaaaattagagatcaagattatgaagtctattctttgtatcaagaacgcaaaatagcttctaaagcatatggaattgatacagttttattctctctaaagaattttcttaattatacaggaactcctgtaaatgaaatgcctaatgcaagagcttttgtaggcctaatagatcccaagtttcctccttcctatcccaatgttactagggaacattatacttcctgtaataataggaaaagaagaagtgttgataataactatgctaagttaaggtctatggggtatgcacttacaggagcagtgcaaaccttatctcaaatatcagatattaatgatgaaaacttacagcaaggaatatatttattaagggatcatgtaataaccttaatggaagctacattgcatgatatatctgttatggaaggaatgtttgctgtacaacatttgcatacacatttgaatcatttgaagacaatgcttctagaaagaagaatagactggacctatatgtctagtacttggctacaacaacaattacagaaatctgatgatgagatgaaagtaataaagagaattgctagaagtttggtatattatgttaaacaaacccatagttctcccacagctacagcctgggagattggattatattatgaattggttatacctaaacatatttacttgaataattggaatgttgtcaatataggtcacttagttaaatcagctggacaattgactcatgtaactatagctcatccttatgaaataatcaataaggaatgtgtagagactatatatctgcatcttgaggactgcacaagacaagattatgtcatatgtgatgtggtaaagatagtgcagccttgtggcaatagctcagacacgagtgattgtcctgtctgggctgaagctgtaaaagaaccatttgtgcaagtcaatcctctgaaaaacggaagttatctggttttggcaagttccacagactgtcagatcccaccatatgttcctagcatcgtgactgttaatgaaacaacgtcatgctttggactggactttaaaaggccactggttgcggaagaaagattgagctttgagccacgactgccaaatctacaactaagattaccacatttggttggaattattgcaaaaatcaaagggataaaaatagaagtcacatcctctggagaaagtataaaagagcagattgaaagagcaaaagctgagctccttcgactggacattcacgagggagatactcctgcctggatacaacagctagctgcagcaacaaaggacgtctggccagcagcagcttctgctctacaaggaattggtaactttttatctgggactgcccaaggaatatttggaactgcctttagtctcttgggatacttaaagcctatcctaataggagtaggggtcattctcttggttattcttatatttaagattgtatcatggattcctacgaaaaagaagaatcagtag

SEQ ID NO: 1291 - DNA, 2031 bp, synthetic construct
  misc_feature 1..2031: note = pGP41 Ebola Zaire virus sequence
  source 1..2031: mol_type = other DNA
atgggcgttacaggaatattgcagttacctcgtgatcgattcaagaggacatcattctttctttgggtaattatccttttccaaagaacattttccatcccacttggagtcatccacaatagcacattacaggttagtgatgtcgacaaactagtttgtcgtgacaaactgtcatccacaaatcaattgagatcagttggactgaatctcgaagggaatggagtggcaactgacgtgccatctgcaactaaaagatggggcttcaggtccggtgtcccaccaaaggtggtcaattatgaagctggtgaatgggctgaaaactgctacaatcttgaaatcaaaaaacctgacgggagtgagtgtctaccagcagcgccagacgggattcggggcttcccccggtgccggtatgtgcacaaagtatcaggaacgggaccgtgtgccggagactttgccttccataaagagggtgctttcttcctgtatgatcgacttgcttccacagttatctaccgaggaacgactttcgctgaaggtgtcgttgcatttctgatactgccccaagctaagaaggacttcttcagctcacaccccttgagagagccggtcaatgcaacggaggacccgtctagtggctactattctaccacaattagatatcaggctaccggttttggaaccaatgagacagagtacttgttcgaggttgacaatttgacctacgtccaacttgaatcaagattcacaccacagtttctgctccagctgaatgagacaatatatacaagtgggaaaaggagcaataccacgggaaaactaatttggaaggtcaaccccgaaattgatacaacaatcggggagtgggccttctgggaaactaaaaaaaacctcactagaaaaattcgcagtgaagagttgtctttcacagttgtatcaaacggagccaaaaacatcagtggtcagagtccggcgcgaacttcttccgacccagggaccaacacaacaactgaagaccacaaaatcatggcttcagaaaattcctctgcaatggttcaagtgcacagtcaaggaagggaagctgcagtgtcgcatctaacaacccttgccacaatctccacgagtccccaatccctcacaaccaaaccaggtccggacaacagcacccataatacacccgtgtataaacttgacatctctgaggcaactcaagttgaacaacatcaccgcagaacagacaacgacagcacagcctccgacactccctctgccacgaccgcagccggacccccaaaagcagagaacaccaacacgagcaagagcactgacttcctggaccccgccaccacaacaagtccccaaaaccacagcgagaccgctggcaacaacaacactcatcaccaagataccggagaagagagtgccagcagcgggaagctaggcttaattaccaatactattgctggagtcgcaggactgatcacaggcgggagaagaactcgaagagaagcaattgtcaatgctcaacccaaatgcaaccctaatttacattactggactactcaggatgaaggtgctgcaatcggactggcctggataccatatttcgggccagcagccgagggaatttacatagaggggctaatgcacaatcaagatggtttaatctgtgggttgagacagctggccaacgagacgactcaagctcttcaactgttcctgagagccacaactgagctacgcaccttttcaatcctcaaccgtaaggcaattgatttcttgctgcagcgatggggcggcacatgccacattctgggaccggactgctgtatcgaaccacatgattggaccaagaacataacagacaaaattgatcagattattcatgattttgttgataaaacccttccggaccagggggacaatgacaattggtggacaggatggagacaatggataccggcaggtattggagttacaggcgttataattgcagttatcgctttattctgtatatgcaaatttgtcttttag

SEQ ID NO: 1292 - DNA, 1485 bp, synthetic construct
  misc_feature 1..1485: note = pGP25 Dengue virus sequence
  source 1..1485: mol_type = other DNA
atgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaataccaccactgactcgagatgtccgacacaaggagaagccacgctggtggaagaacaagacacgaactttgtgtgtcgacgaacattcgtggacagaggctggggcaatggttgtggactattcggaaagggtagcttaataacgtgtgctaagtttaagtgtgtgacaaaattggaaggaaagatagtccaatatgaaaacttaaaatattctgtgatcgttaccgtccacactggagaccagcaccaagttggaaatgagaccacagaacatggaacaattgcaaccataacacctcaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggacctcaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagctggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcg

SEQ ID NO: 1293 - DNA, 1518 bp, synthetic construct
  misc_feature 1..1518: note = pGP26 Zika virus sequence
  source 1..1518: mol_type = other DNA
atgatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggtccacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaatcctcattggaacgttgctgatgtggttgggtctgaacacaaagaatggatctatttcccttatgtgcttggccttagggggagtgttgatcttcttatccacagccgtctctgcttag

SEQ ID NO: 1294 - DNA, 1284 bp, synthetic construct
  misc_feature 1..1284: note = pGP27 West Nile virus sequence
  source 1..1284: mol_type = other DNA
atgttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtacgaagtggccatttttgtccatggaccaactactgtggagtcgcacggaaactactccacacaggttggagccactcaggcagggagattcagcatcactcctgcggcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaagaaccacacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaagcctttacaaccaccctcaaaggagcgcagagactagccgctctaggagacacagcttggtag

SEQ ID NO: 1295 - DNA, 1506 bp, synthetic construct
  misc_feature 1..1506: note = pGP28 Japanese encephalitis virus sequence
  source 1..1506: mol_type = other DNA
atgttcaactgtctgggaatgggcaatcgtgacttcatagaaggagccagtggagccacttgggtggacttggtgctagaaggagatagctgcttgacaatcatggcaaacgacaaaccaacattggacgtccgcatgattaacatcgaagctagtcaacttgctgaggtcagaagttactgctatcatgcttcagtcactgacatctcgacggtggctcggtgccccacgactggagaagcccacaacgagaagcgagctgatagtagctatgtgtgcaaacaaggcttcactgatcgtgggtggggcaacggatgtggactcttcgggaaggggagcattgacacatgtgcaaaattctcctgcactagcaaagcgattgggagaacaatccagccagaaaacatcaaatacgaagttggcatttttgtgcatggaaccaccacttcagaaaaccatgggaattattcagcgcaagttggggcttcccaggcggcaaagtttacagtaacacccaatgctccttcgataaccctcaaacttggtgactacggagaagtcacgctggactgtgagccaaggagtggactgaacactgaagcgttttacgtcatgaccgtggggtcaaagtcatttctggtccatagggaatggtttcatgacctcgctctcccctggacgtctccttcgagcacagcgtggagaaacagagaactcctcatggaatttgaagaagcgcacgccacaaaacagtccgttgttgctcttgggtcacaggaaggaggcctccatcaggcgctggcaggggccattgtggtggagtactcaagctcagtaaagctaacatcaggccacctgaaatgcaggctaaaaatggacaaactggccctgaaaggcacaacctatggcatgtgtacaggaaaattctcgttcgcgaaaaatccggcggacactggccacggaacagttgtcattgaactctcctactctgggagagacggcccctgcaaaattccgattgtctccgttgcgagccttaatgacatgactcccgttgggcggctggtgacagtgaaccctttcgtcgcgacttccagtgctaactcaaaggtgctggtcgagatggaaccccctttcggagactcctacatcgtggttgggaggggagacaagcagattaaccaccattggcacaaagctggaagcacgctaggcaaggccttttcaacaactttgaagggggctcaaaggctggcagcgttgggcgacacagcctgggactttggctctattggaggggtcttcaactccataggaaaagccgtccaccaagtgtttggtggtgccttcagaacactcttcgggggaatgtcttggatcacacaagggctaatgggtgccctactgctttggatgggcgtcaacgcacgagaccgatcaattgctctggccttcttagccacaggaggtgtgctcgtgttcttagcgaccaatgtgcatgcttag

SEQ ID NO: 1296 - DNA, 1666 bp, synthetic construct
  misc_feature 1..1666: note = pGP31.1 Mumps virus F sequence
  source 1..1666: mol_type = other DNA
gcaaagcacgtgagatcgccaccatgaaagtcttcctcgtgacctgtcttggcttcgccgtgttcagcagttctgtgtgtgtgaatatcaacatactgcagcagatcggctatatcaaacaacaagtgaggcagctctcctattactctcagagtagcagctcttacattgtcgttaagctgctccccaatattcaaccaacagacaatagttgtgagtttaagtcagtaacgcaatataacaaaactctgtctaacctcttgctccctatagccgagaacattaataacattgcatcaccatcatctggaagcagaaggcataaacgcttcgctgggattgccataggcattgcggccctcggcgtggcgacagctgcccaagtaaccgcggctgtcagcctcgttcaagcccagaccaatgccagagctatcgctgcgatgaagaatagcatccaggccactaaccgagcagtcttcgaagttaaggaaggcacacagcggcttgccatcgcggtacaagccattcaagatcatattaacacaattatgaatactcaactgaataacatgtcatgtcagatccttgataaccaactggctacatctctgggcttgtacctgaccgagctgaccactgtctttcagccccaactgatcaaccctgccctgtcacctatcagcattcaagcactcaggtcacttcttgggtccatgactcccgctgtcgtgcaagctacactctcaacatccatctctgcagccgaaattctgtccgctggcctcatggaaggccaaattgtgagcgttctcctcgatgagatgcagatgatagtcaaaattaacattcctaccatagtgacgcaatcaaacgcactcgtaatcgacttttacagtatctctagcttcattaataaccaagaatctatcatccaattgccagatcggatccttgaaatcggaaatgaacagtggagttatcctgcgaagaactgtaaattgacgagacaccacatcttctgtcaatacaatgaggccgaaagactcagcctcgaatctaaactctgcttggcaggcaatatcagcgcctgtgtattcagccctatcgcagggtcttatatgcggcgctttgtagcactcgacggaacaatagtcgctaactgccgatcattgacctgtctgtgcaagagccccagctaccctatttatcaacccgaccaccatgctgttactacgattgacctcactgcgtgccagaccttgagcctcgatgggctcgattttagtatagtctctctgagtaatataacatatgctgaaaacttgacaatcagcctgagtcagactatcaacactcagcccattgatatttccacggaacttagtaaagtaaacgccagcctgcaaaacgcagttaaatatataaaggaatccaatcatcaactccaaagcgtaaacgttaatagcaaaataggcgccatcattgtggctgcactggtcctctcaatcctgtcaatcattatcagccttttgttctgttgctgggcttacgtagccactaaagagatcaggcggatcaacttcaaaacgaaccacattaacacaatttcatctagcgtcgatgatctcatccggtacttataagatctgaattcaccccaccagtg

SEQ ID NO: 1297 - DNA, 1798 bp, synthetic construct
  misc_feature 1..1798: note = pGP31.2 Mumps virus HN sequence
  source 1..1798: mol_type = other DNA
gcaaagcacgtgagatcgccaccatggaacctagtaagcttttcaccatgtccgataatgctacattcgcaccaggccccgtcattaacgcagccgacaagaaaacattccgtacatgtttccgcattctggtcctgtcagtccaggcagtcactcttattctggtaattgttactctgggcgaactcgttcgcatgattaacgaccagggactgtctaaccagctctcctctattgccgataagatcagagagtccgccaccatgatcgcatcagcagtcggagtgatgaatcaagtgattcatggggtgacagtttcactgccactccaaatagaaggaaatcaaaatcagcttctctcaactcttgccacgatttgcacaggaaagaagcaggtttctaactgttctactaacataccattggtgaatgatctgcggtttattaatgggatcaataagttcatcattgaagactatgctacgcatgacttcagcattggccacccgctgaatatgcctagttttatcccaacagccacaagccccaatggttgcacccggattccgtcctttagcttggggaaaacccattggtgctatacccacaatgttattaacgctaattgcaaagatcatacatcttccaatcaatacattagcatgggcatccttgtacaaacggcctcaggctatcccatgtttaaaactctgaaaatacaatatctgagcgatggcctgaacaggaagagttgctctatcgcaaccgtgcctgatgggtgcgcaatgtactgttatgtgagtacccaacttgaaaccgatgactatgcaggctcttctccccctacccagaaactgacactgctgttctataacgatactgttacggagcgtaccataagccccactggacttgaaggtaattgggctacccttgtgcctggagtaggatccggtatctactttgagaataagctcatattccctgcgtatggcggggtgctgcccaacagttctctcggcgtcaagagtgcacgcgagttcttcagaccagtgaacccctataatccctgctcagggccccaacaagacttggatcagcgcgcacttagatcctattttccttcctattttagtaatcgtcgagtccagagcgctttcctcgtgtgtgcttggaatcagattttggtaacaaactgtgaactggtcgtcccatccaataatcaaacccttatgggagcagaagggcgggtcctgcttattaacaaccgactgctctactaccaaagaagcacaagttggtggccatacgaacttctctatgaaatttccttcacattcaccaacagtggtcagagctcagtgaatatgagttggatacccatatatagctttacacgacctggatcaggcaactgtagcggggaaaatgtttgtcctacagcatgtgtaagtggcgtttatctggatccgtggccgcttaccccatactcccatcaatccggtattaaccgaaatttctatttcactggcgcactcttgaacagtagtacgacaagagtaaaccccaccctgtacgtttcagctttgaacaatcttaaggtgctggctccatatggaaatcagggtctgtttgcttcctacactactacaacatgtttccaagataccggagatgcctctgtatattgtgtgtatatcatggaactggcgtcaaacatcgtcggcgaatttcaaatattgcccgtcctgactcggctgacaataaccttataagatctgaattcaccccaccagtg

SEQ ID NO: 1298 - DNA, 1747 bp, synthetic construct
  misc_feature 1..1747: note = pGP33.1 Sendai virus F sequence
  source 1..1747: mol_type = other DNA
gcaaagcacgtgagatcgccaccatgactgcatacattcaaagaagccaatgcattagcacaagtctccttgtggtgctgacgaccctcgtttcctgtcagatcccgcgtgatcgactttccaatatcggggttattgtcgacgagggcaagtccttgaaaatcgcaggttcccacgagtctaggtacatcgtgctgtcactggttcccggcgtcgactttgagaatggttgcggtacagcccaagtaattcagtacaagagcctgctcaacaggcttctgatccctctccgagatgccttggatctgcaagaagctctgattactgtgacgaacgacacgactcaaaatgccggggctccacagtctcgcttcttcggcgcagtgatcggcacgatcgctctgggcgttgccacttccgctcagatcaccgctggtattgcccttgctgaagctcgggaagccaaacgtgatattgcgctgataaaggagagcatgacaaagactcataagtcaatcgaactgcttcagaacgccgtgggagagcaaattcttgctctcaaaaccctgcaggacttcgtgaatgatgagattaaaccagccatcagtgaactgggttgcgagactgctgctctgcgtctgggaattaaactgacccaacattactccgagctcctcactgctttcggctctaactttggaacgattggagagaaaagcctgacccttcaggctctctcttctctctactccgccaacatcacagagattatgacgacgatcaaaacggggcaatccaacatttatgatgtcatttatactgagcagatcaaaggtaccgtgatcgatgttgacctggaaaggtacatggtgacactctcagtcaaaatccccatcctcagtgaggtgccaggcgtattgattcataaagcaagcagcattagctataacatagatggggaagagtggtacgttaccgtccccagtcatatactgtctagagccagtttcctcggtggtgcagatataaccgactgtgtggagagccggctgacctatatttgtccgcgcgatcccgcacaattgattccagacagccagcaaaagtgcatcctcggggacaccacacgatgtcctgttacgaaggtagtcgactcactgatccccaagttcgccttcgtcaacggtggcgtagttgccaattgcattgccagcacttgtacatgtggcacaggacgcagacctattagccaagatcgttcaaagggcgtggttttcctcacacacgataattgcggactgataggggtgaacggtgttgaactttacgctaaccgcagaggacacgatgcaacatggggcgtacagaatttgacagtcgggcctgcaattgcaatacgtcctatcgacatctctctcaacctggcggacgctaccaattttctgcaagactccaaggctgaacttgagaaagcgaggaagattctgtccgaagtcggccgatggtataactctcgggaaactgtcattaccatcattgtcgtgatggttgtcattttggtggtgatcattgtgataattattgtcctctataggctgaggagatctatgctgatgggtaacccggatgacagaatcccacgcgacacgtacacccttgagccgaaaattcggcatatgtatacgaatggtggatttgatgcaatggcggaaaagcgcttataagatctgaattcaccccaccagtg

SEQ ID NO: 1299 - DNA, 1777 bp, synthetic construct
  misc_feature 1..1777: note = pGP33.2 Sendai virus HN sequence
  source 1..1777: mol_type = other DNA
gcaaagcacgtgagatcgccaccatggatggcgaccgaggcaaacgcgactcttattggagcacttcccctagtgggtccaccactaagccggctagcggatgggagagatcaagtaaggccgatacgtggctcttgatcttgagcttcacccaatgggctttgagtattgctactgttattatttgcatcatcatctcagctcggcaaggatactctatgaaagagtacagcatgacggtggaagcattgaatatgtcttctcgggaagtgaaggaatcactcacatctttgattaggcaggaagtcatagcccgggctgtgaatatccaatccagcgtccaaacagggatcccggtgctcctgaacaagaactcccgagacgtcatccaaatgatcgataaatcttgttcacgccaagaacttacccaacattgtgaaagcactattgccgtccatcacgcagacggcattgcacccctggagccgcactcattctggcgttgcccggttggtgaaccctatctgtcatctgaccccgagatcagtctgctccctggaccttcactcctctccggttccaccacgataagcgggtgtgtcaggttgccatccctctccatcggggaagcgatttatgcgtatagcagcaacttgattacgcaaggctgtgctgacatcggtaagtcctaccaggtgcttcagcttggttatatcagccttaattctgatatgtttccggacctcaatcctgtggtctcacatacatatgacatcaatgacaacagaaaatcctgtagcgtagtcgcaacagggacgagagggtatcaactctgttctatgcctacagtcgacgagagaactgattatagctcagacggaatcgaagatctcgtcctggacgttctcgatttgaaaggtcgcacaaaatcacaccgctacagaaattccgaggtggacctcgatcatcctttctccgcgttgtatcctagtgtgggcaacggcattgctactgaaggctccttgattttcctcgggtacggcggcctcaccacacccttgcaaggtgatacaaaatgccgtacgcaaggctgccaacaggtttctcaagatacttgcaacgaggctctgaagataacttggcttggcgggaaacaagtggtttctgtgatcattcaggtcaatgattacctgagtgaaaggcctaaaattagggtcaccaccattcccattacccaaaactatctcggtgctgagggcaggctgttgaagctcggtgatcgggtctatatatatactcggagcagtggttggcactctcaactgcaaataggggtcttggacgtgtcccacccgttgaccattaattggacacctcatgaggcgctgtcacggccagggaataaagaatgcaactggtacaataagtgccccaaagaatgtatctccggggtctacacagacgcttaccccctgtctccagatgctgctaatgtcgctacagttactctgtacgccaatacttctagagtgaaccccactattatgtattccaacacgaccaatataatcaatatgcttcggataaaagatgtacaacttgaagccgcttacactactacgtcctgtataacacactttgggaaaggctattgctttcacatcattgagattaatcaaaagagtctgaatactctccaacccatgctgtttaaaacatcaatcccaaaattgtgtaaagcggaaagtttataagatctgaattcaccccaccagtg

SEQ ID NO: 1300 - DNA, 1590 bp, synthetic construct
  misc_feature 1..1590: note = pGP59 AcMNPV gp64 sequence
  source 1..1590: mol_type = other DNA
atgctgctcgtgaaccagagccaccagggcttcaacaaggagcatacatccaaaatggtgtccgccatcgtgctgtacgtgctgctggccgccgctgcccacagcgcttttgccgccgagcattgtaatgctcagatgaaaaccggcccttacaagatcaagaacctggacatcacccctcctaaggagacactgcaaaaagacgtggaaatcaccatcgtggaaaccgactacaatgagaacgtgatcatcggatataagggctactaccaggcctacgcctacaacggcggaagcctggatcctaacaccagagtggaagagaccatgaagaccctgaacgtgggaaaggaagatctgctgatgtggagcatccggcaacagtgtgaagtgggcgaagagctgattgatagatggggctcagattctgacgattgcttcagagacaacgagggcagaggccagtgggtgaagggcaaggagctggtcaagcggcagaacaacaaccacttcgcccatcacacatgcaacaaaagctggcggtgcggcatctccacctctaagatgtattctagactggaatgtcaggacgacaccgacgagtgccaggtgtacatcctggacgctgaaggaaaccctatcaacgtgacagttgacaccgtgctgcaccgggacggcgtgtctatgatcctgaagcagaagagcacattcaccaccagacagatcaaggccgcatgcctgcttatcaaagacgacaagaacaaccccgagagcgtgaccagagaacactgcctgatcgacaacgacatctacgacctgagcaagaatacttggaactgtaaattcaacaggtgcatcaagcggaaggtggagcacagagtgaagaagcgtccaccaacctggcgccacaacgtcagagccaagtacacagagggcgacacagccacaaagggagatctgatgcacatccaggaggaactgatgtacgagaatgacctgcttaaaatgaacatcgagctgatgcacgcccacatcaacaagctgaacaacatgctgcacgacctgatcgttagcgtggccaaggtggacgagagactgatcggcaatctgatgaacaacagcgtgtccagcaccttcctgtctgatgacacctttctgctcatgccttgcaccaacccccccgcccacaccagcaactgctacaacaacagcatctacaaggaaggcagatgggtcgctaataccgatagcagtcagtgcatcgacttcagcaattacaaggagctggccatcgacgatgatgtggagttctggattcctacaattggcaacacaacctaccacgatagctggaaggacgccagcggatggtcttttatcgcccagcagaaaagcaatctgatcaccaccatggaaaataccaagttcggcggcgtgggtacatctctgagcgacatcacaagcatggccgagggcgagctggccgccaagctgaccagcttcatgttcggccacgtcgtgaacttcgtgatcatcctgatcgtgattctgttcctgtactgcatgatcagaaaccggaacagacaatac

SEQ ID NO: 1301 - DNA, 2955 bp, synthetic construct
  misc_feature 1..2955: note = pGP54 Ross River virus sequence
  source 1..2955: mol_type = other DNA
atgtctgccgcgctgatgatgtgtatccttgccaacacctctttcccctgctcatcacctccctgctacccctgctgctacgaaaaacagccagaacagacactgcggatgctggaagacaatgtgaatagaccagggtactatgagctactggaagcgtccatgacatgcagaaacagatcacgccaccgccgtagtgtaacagagcacttcaatgtgtataaggctactagaccgtacttagcgtattgcgctgactgtggggacgggtacttctgctatagcccagttgctatcgagaagatccgagatgaggcgcctgacggcatgctcaagatccaagtctccgcccaaataggtctggacaaggcaggtacccacgcccacacgaagatccgatatatggctggtcatgatgttcaggaatctaagagagactccttgagggtgtacacgtccgcagcgtgctctatacatgggacgatgggacacttcatcgtcgcacattgtccgccaggcgactacctcaaggtttcgttcgaggacgcagattcacacgtgaaggcatgtaaggtccaatacaagcacgacccattgccggtgggtagagagaagttcgtggttagaccccactttggcgtagagctgccatgcacctcataccagctgacaacagctcccaccgacgaggagatcgacatgcacacaccgccagatataccggatcgcaccctgctatcacagacggcgggcaacgtcaaaataacagcaggcggcaggactatcaggtacaattgtacctgtggccgtgacaacgtaggcactaccagtactgacaagaccatcaacacatgcaagattgaccaatgccatgctgccgttaccagccatgacaaatggcaatttacctctccatttgttcccagggctgatcagacagctaggaggggcaaagtgcatgttccattccctttgactaacgtcacctgccgagtgccgttggctcgagcgccggatgtcacctatggtaagaaggaggtgaccctgagattacacccagatcatccgacgctcttctcctataggagtttaggagccgaaccgcacccgtacgaggagtgggttgacaagttctctgagcgcatcatcccagtgacggaagaagggattgagtaccagtggggcaacaacccgccggtccgcctatgggcgcaactgacgaccgagggcaaaccccatggctggccacatgaaatcattcagtactattatggactataccccgccgccaccattgccgcagtatccggggcgagtctgatggccctcctaactctagcggccacatgctgcatgctggccaccgcgaggagaaagtgcctaacaccatacgccttgacgccaggagcggtggtaccgttgacactggggctgctttgctgcgcaccgagggcgaacgcagcatcattcgctgagactatggcatatctgtgggacgagaacaaaaccctcttttggatggaattcgccgccccagccgcagcgcttgctttgctggcatgctgtatcaaaagcctgatctgctgttgtaagccattttcttttttagtgttactgagcctgggagcctccgcaaaagcttacgagcacacagccacaattccgaatgtggtggggttcccgtataaggctcacattgaaaggaatggcttctcgcccatgactctgcagcttgaagtggtggagacaagctgggaacccacacttaacctggagtacattacctgcgaatacaagacggtggtcccttcgccattcatcaaatgttgcggaacatcagaatgctcatccaaggagcagccagactaccaatgcaaggtgtacacgggtgtatacccattcatgtggggtggagcctactgtttctgcgactccgagaacacgcagctcagcgaggcctatgtcgacaggtcagacgtttgcaaacatgatcacgcatcggcctacaaggcacacacggcctctctaaaagcaacaatcaggatcagttatggcaccatcaaccagaccaccgaggccttcgttaatggtgaacacgcggtcaacgtgggcggaagcaagttcatctttggaccgatctcaacagcttggtcaccgttcgacaataaaattgtcgtgtataaagatgatgtctacaaccaggacttcccaccctacggatcaggccagccgggtagattcggagacattcagagcaggacagtggagagcaaagacttgtatgccaacacggccctaaaactctcaagaccatcacccggggttgtgcatgtgccatacacgccgacaccatccggatttaaatattggctgaaggagaaaggatcttcattgaatacaaaggccccttttggctgcaagataaagaccaatccagtcagagccatggattgtgcagttggcagtatacctgtgtcgatggacatacctgacagtgcattcacacgagtggtagatgccccggctgtaacagacctgagctgccaggtagtggtctgtacacactcctccgatttcggaggagttgccacattgtcttacaaaacggacaaacccggcaagtgcgctgtccactcacattccaacgtcgcaacgttgcaagaggcgacggtggatgtcaaggaggatggcaaggtcacagtgcacttttccacggcgtccgcctccccggccttcaaagtgtccgtctgtgacgcaaaaacaacgtgcacggcggcgtgcgagcctccaaaagaccacatcgtcccttatggggcgagccataacaaccaggtctttccggacatgtcaggaactgcgatgacgtgggtgcagaggctggccagtgggttaggtgggctggctctcatcgcggtggttgtgctggtcttggtaacctgcataacaatgcgtcgg

SEQ ID NO: 1302 - DNA, 1407 bp, synthetic construct
  misc_feature 1..1407: note = pGP82 N1 neuraminidase sequence
  source 1..1407: mol_type = other DNA
atgaatcctaatcagaaaatcattaccatcggtagcatctgcatgatcgtgggcattatcagcctgatcctgcagatcggcaacatcatcagcatctgggtgtcccacagcatccagaccggaaatcagaaccaacctgagatctgcaaccagagcatcattacatacgagaacaacacatgggtcaaccaaacatacgtgaacatcagcaacaccaacttcgtgaccgagcaggccctggctcctgtggccctggccggcaacagcagcctgtgccccatttcaggatgggccatctacagcaaggacaacggcatccggatcggaagcaagggcgatgtgttcgtgatccgcgagcctttcatctcttgcagccatctggaatgtagaacttttttcctgacccagggcgccctgctgaatgataagcactctaatgggaccgtgaaagacagaagcccttatagaaccctgatgagctgtcctatcggcgaaagcccttctccttacaacagcagattcgagagcgtggcttggtccgcctctgcttgtcacgacggcatcggctggctgaccatcggcatcagcggtccagataacggcgctgtggccgttctgaagtacaacggcatcatcacagatacaatcaagagctggcggaacaacatcctgcggacacaggagagcgagtgcgcctgtatgaacggctcctgctttaccatcatgaccgatggccctagcaacggccaggccagctacaagatcttcaagatcgagaagggcaaggtggtgaaaagcgtcgagctgaacgcccctaactaccactacgaggaatgcagctgttaccctgacgccggagaaatcatgtgcgtgtgccgggacaactggcacggcagcaatagaccctgggttagcttcaaccagaacctggagtaccagatcggctacatctgtagtggggtgttcggcgacaaccccagacctaatgacggcgcaggcagctgcggccccgtgagcagcaacggagcctacggagtgaagggattctcctttaagtacggcaaaggagtgtggatcggcagaaccaagtcaacaagcagcagatctggcttcgagatgatctgggaccccaacggctggaccgaaaccgacagcagcttcagcgtgaagcaggacattgtggccatcaccgactggtccggatattctggctctttcgtccagcaccctgaactgacaggcctggactgcatgagaccatgcttctgggtggaactgatcaggggccggcccaaggaaaacaccatctggaccagcggctctagcatcagcttttgcggcgtgaatagtgatacagtgggctggagctggcctgatggcgccgagctccccttcaccatcgacaag

SEQ ID NO: 1303 - DNA, 1485 bp, synthetic construct
  misc_feature 1..1485: note = pGP75 Dengue virus 2 sequence
  source 1..1485: mol_type = other DNA
atgaggtgcatcggcatcagcaacagggacttcgtggagggcgtgagcggcggcagctgggtggacatcgtgctggagcacggcagctgcgtgaccaccatggccaagaacaagcccaccctggacttcgagctgatcaagaccgaggccaagcaccccgccaccctgaggaagtactgcgtggaggccaagctgaccaacaccaccaccgccagcaggtgccccacccagggcgagcccagcctgaacgaggagcaggacaagaggttcgtgtgcaagcacagcatggtggacaggggctggggcaacggctgcggcctgttcggcaagggcggcatcgtgacctgcgccatgttcacctgcaagaagaacatggagggcaaggtggtgcagcccgagaacctggagtacaccatcgtgatcaccccccacagcggcgaggagaacgccgtgggcaacgacaccggcaagcacggcaaggagatcaaggtgaccccccagagcagcatcaccgaggccgagctgaccggctacggcaccgtgaccatggagtgcagccccaggaccggcctggacttcaacgagatggtgctgctgcagatggagaacaaggcctggctggtgcacaggcagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacagcatgtgcaccggcaagttcaaggtggtgaaggagatcgccgagacccagcacggcaccatcgtgatcagggtgcagtacgagggcgacggcagcccctgcaagatccccttcgagatcatggacctggagaagaggcacgtgctgggcaggctgatcaccgtgaaccccatcgtgaccgagaaggacagccccgtgaacatcgaggccgagccccccttcggcgacagctacatcatcatcggcgtggagcccggccagctgaagctgagctggttcaagaagggcagcagcatcggccagatgttcgagaccaccatgaggggcgccaagaggatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtggtgatcacctggatcggcatgaacagcaggagcaccagcctgagcgtgagcctggtgctggtgggcgtggtgaccctgtacctgggcgtgatggtgcaggcc

SEQ ID NO: 1304 - DNA, 1479 bp, synthetic construct
  misc_feature 1..1479: note = pGP76 Dengue virus 3 sequence
  source 1..1479: mol_type = other DNA
atgaggtgcgtgggcgtgggcaacagggacttcgtggagggcctgagcggcgccacctgggtggacgtggtgctggagcacggcggctgcgtgaccaccatggccaagaacaagcccaccctggacatcgagctgcagaagaccgaggccacccagctggccaccctgaggaagctgtgcatcgagggcaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccagccaggccagcaccgccgaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccagcggcgccaccaccaagacccccacctggaacaggaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcaggctgaagatggacaagctgaagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcaggctgatcaccgccaaccccgtggtgaccaagaaggaggagcccgtgaacatcgaggccgagccccccttcggcgagagcaacatcgtgatcggcatcggcgacaaggccctgaagatcaactggtacaggaagggcagcagcatcggcaagatgttcgaggccaccgccaggggcgccaggaggatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgccatcggcatcatcaccctgtacctgggcgtggtggtgcaggcc

SEQ ID NO: 1305 - DNA, 216 bp, synthetic construct
  misc_feature 1..216: note = pGP77 Dengue virus 4 sequence
  source 1..216: mol_type = other DNA
ttcggcagcgtgggcggcctgttcaccagcctgggcaaggccgtgcaccaggtgttcggcagcgtgtacaccaccatgttcggcggcgtgagctggatgatcaggatcctgatcggcttcctggtgctgtggatcggcaccaacagcaggaacaccagcatggccatgacctgcatcgccgtgggcggcatcaccctgttcctgggcttcaccgtg

SEQ ID NO: 1306 - DNA, 1647 bp, synthetic construct
  misc_feature 1..1647: note = pGP34.1 Nipah virus sequence
  source 1..1647: mol_type = other DNA
gccaccatggtggtgatcctggataagcggtgctactgtaatctgctgattctgattctcatgatctctgaatgcagcgtaggaatcctgcactacgagaagctgagcaagatcggactggtgaaaggcgtgacccgcaagtacaagatcaaaagcaaccctctgaccaaggacatcgtgatcaagatgatacccaatgtgtccaacatgagccaatgtaccggcagcgtgatggaaaactacaagacccggctgaacggcatcctgaccccaatcaagggcgccctggaaatctacaaaaacaacacccacgacctggtgggcgacgtgcggctggctggcgtgatcatggccggcgtggccatcggcatcgccaccgccgcccagatcaccgccggagtggccctttatgaggccatgaagaacgccgacaacatcaacaagctgaagagtagcatcgagtctacaaacgaggccgtggtgaagctgcaggagacagccgagaaaaccgtctatgtgctgacagctctgcaggactacatcaacaccaatctggtgcctaccatcgacaagatcagctgcaagcagacagagctgagcctggacctggccctgtctaagtacctgagcgacctgctgttcgtcttcggacctaatttgcaggatcctgtgagcaacagcatgaccatccaggccattagccaggcttttggcggcaactacgagacactgctcagaacactgggctacgccacagaagacttcgacgacctgctggaaagcgatagcatcaccggacagatcatctacgtggacctgagcagctactacattatcgtgagagtgtacttccccattctgaccgagatccagcaggcctacatccaggagctgctgcctgtgtccttcaataatgataactcagaatggatcagcatcgtgcccaacttcatcctcgtgcggaacaccctgatcagcaacatcgagatcggcttctgcctgatcaccaagcggagcgtgatctgcaaccaggactacgccacccctatgacaaacaacatgagagagtgcctgaccggcagcacagagaagtgccccagagaactggtcgtgtctagccacgtgccaagattcgctctgtccaatggcgtgctgtttgccaactgcatcagcgtcacctgtcagtgtcagaccaccggcagagccatcagccagagcggcgagcagaccctgctgatgatcgacaatactacatgccctaccgctgtgctgggaaatgtgatcatctccctgggcaagtatctgggttccgttaactacaactccgagggcatcgccatcggccctcctgttttcaccgacaaggtggacatctcctctcagatcagcagcatgaaccagtctctgcaacaaagcaaggattacatcaaggaagctcaaagactgctggacacagtgaaccccagcctgatcagcatgctgagcatgatcatcctgtacgtgctgtctatcgcctctctgtgcatcggcctcatcacatttatcagcttcatcattgttgaaaaaaagagaaacacatacagcagactggaagatagaagggtgcggcctacaagctctggcgatctgtactacatcggcacctga

SEQ ID NO: 1307 - DNA, 8527 bp, synthetic construct
  misc_feature 1..8527: note = pGP34.2 Nipah virus sequence
  source 1..8527: mol_type = other DNA
gccaccatgcctgctgagaacaagaaggtgcggttcgagaacacaacctccgataagggaaagatccccagcaaggtgattaagtcttattacggcaccatggacatcaagaagatcaatgaaggcctcctcgacagcaagattctgtccgcctttaacacagtgatcgccctgctgggaagcattgtgatcatcgtcatgaacatcatgatcatccagaactacaccagatctacagataatcaagccgttatcaaggacgccctgcagggcatccagcagcagatcaagggcctggccgacaagatcggcacagaaatcgggcctaaggtgtccctgatcgacaccagcagcaccatcaccatcccagccaacatcggactgctgggtagcaagatctcccagagcacagcctcgattaacgagaacgtgaacgaaaagtgcaagttcaccctgccacctctgaagatccacgagtgcaacataagctgtcctaaccctctgccttttcgggaataccggccccagacagagggagtgagcaatctggtgggcctgccgaacaacatctgcctgcagaaaaccagcaatcaaatcctgaaacctaaactgatctcttatacactgcctgtggtgggccagtctggcacctgtatcaccgaccccctgctggctatggatgagggctacttcgcctacagccatctggaacggatcggctcttgtagcagaggcgtgtccaaacagagaatcatcggcgttggcgaggtcctggatagaggagatgaagtgccttctctgttcatgacaaacgtgtggacccctccaaaccctaacaccgtgtaccactgcagcgccgtgtacaacaacgagttttactacgtgttgtgcgccgtatccaccgtgggcgaccctatcctgaacagcacctactggagcggcagcctgatgatgaccagacttgccgtgaagcctaaaagcaacggcggcggatataaccagcaccagctggctctgagatctatcgagaagggcagatacgacaaggtgatgccctacggcccttctggcatcaagcagggcgacacactgtacttccccgctgtgggtttcctggtgcggaccgagttcaagtacaatgacagcaactgccccatcaccaagtgtcagtactccaaacccgagaactgcagactgtccatgggcatcagacctaatagccactacatcctgaggagcggcctgctgaaatacaacctgtctgacggcgagaatcctaaggtggtgttcatcgagatctctgaccagcgcctgagcatcggaagtcctagcaagatctacgatagcctgggccagcctgtgttctaccaggcgagcttcagctgggacaccatgatcaaattcggcgacgtgctgaccgtgaacccactggtcgtgaactggcgaaacaacacggtgatcagcagacctggccagagccaatgtcccagattcaatacatgccccgaaatctgctgggagggagtgtacaacgacgctttcctcatcgacagaatcaactggatcagcgccggcgtgttcctggacagcaatcagacagccgagaatcccgtgtttacagtgtttaaagataacgaaatcctgtacagagcccagctggccagcgaagataccaacgcccagaagaccatcacaaattgcttcctgctgaagaacaagatctggtgcatctccctggtggaaatctacgacaccggcgataacgtgatccggcctaagctgttcgccgttaagatccccgagcagtgcacctgatctagaagttgtctcctcctgcactgactgactgatacaatcgatttctggatccgcaggcctaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgtctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaagcgatctgcatctcaattagtcagcaaccatagtcccgcccctaactccgcccatcccgcccctaactccgcccagttccgcccattctccgccccatcgctgactaattttttttatttatgcagaggccgaggccgcctcggcctctgagctattccagaagtagtgaggaggcttttttggaggcctaggcttttgcaaaggaggtagccaacatgattgaacaagatggattgcacgcaggttctcccgccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactccaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcggatgcccgacggcgaggatctcgtcgtgacccacggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctagtatgtaagccctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgcctggagacgccatccacgctgttttgacctccatagaagacaccgggaccgatccagcctcccctcgaagcttacatgtggtaccgagctcggatcctgagaacttcagggtgagtctatgggacccttgatgttttctttccccttcttttctatggttaagttcatgtcataggaaggggagaagtaacagggtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaaggcggccgctgccaagcttccgagctctcgaattc

SEQ ID NO: 1308 - DNA, 1647 bp, synthetic construct
  misc_feature 1..1647: note = pGP35.1 Hendra virus sequence
  source 1..1647: mol_type = other DNA
gccaccatggccacgcaggaggtgcgcctgaagtgcctgctctgtggcatcatcgtgctggtcctgagcctggaaggcctgggcatcctgcactacgagaagctgagcaagatcggactggtgaagggcatcacaagaaagtataagatcaagagcaatcctctgaccaaagacatcgtcatcaagatgattcctaacgtctccaatgtgtccaagtgcacaggaacagtgatggaaaactataagagcagactgaccggcatcctgtctccaatcaaaggcgccatcgagctgtacaacaacaacacccacgaccttgttggcgacgtgaagctggccggcgtggtgatggccggcatcgccatcggcattgccacagctgctcagatcaccgccggagtggccctgtacgaggccatgaagaacgccgacaacatcaacaagctgaaaagcagcatcgagagcaccaacgaggccgtggtgaaactgcaggagaccgccgagaagaccgtgtacgttctgaccgccctgcaggactacatcaacacaaacctggtccccaccatcgaccagatcagctgcaaacagacagagctggccctggacctggctcttagtaaatacctgtctgatctgctgttcgtgttcggccctaacctgcaagaccccgtgtctaatagcatgacaatccaggccatctcccaggcttttggcggaaattatgaaaccctgctgagaaccctgggctacgccacagaagatttcgacgatctcctggaaagcgacagcatcgccggccagatcgtctacgtggacctgagctcctactacattattgtgcgggtgtacttccccatcctgactgaaatccagcaggcttacgtgcaggagctgctgcctgtgtcttttaacaacgacaacagcgagtggatctctatcgtgcccaatttcgtgctgatccggaacacactgatcagcaacatcgaggtgaagtactgcctgatcacaaagaagtctgtgatctgcaaccaggactacgccacccctatgaccgcatctgtgcgggaatgcctgacaggcagcaccgataagtgtcctagagagctggtggtgagcagccacgtgcctagatttgccctgagcggcggcgtgctcttcgccaactgcatcagtgttacatgccagtgccaaacaaccggcagagccatcagccagagcggtgagcagaccctgctgatgatcgacaataccacctgtaccaccgtggtcctgggcaatatcatcattagcctggggaagtacctgggatctatcaactacaattctgagtctatcgccgttggaccacctgtgtacaccgacaaggtggatatcagcagccagatcagcagcatgaaccagagccttcaacaaagcaaggactacatcaaggaagcccagaagatcctggacaccgtgaaccccagcctgatcagcatgctgagcatgatcatcctgtacgtgctgtccatagccgctctgtgtatcggcctgatcaccttcatcagcttcgtgatcgtggaaaagaaaagaggcaactacagcagactggatgatagacaggtgcggcctgtgtccaacggcgacctgtattacatcggcacctga

SEQ ID NO: 1309 - DNA, 1821 bp, synthetic construct
  misc_feature 1..1821: note = pGP35.2 Hendra virus sequence
  source 1..1821: mol_type = other DNA
gccaccatgatggccgactctaagctggtgtccctgaacaacaatctgtccggcaagatcaaagatcagggcaaggtgattaagaactactacggcacaatggacatcaagaagatcaacgacggcctgctggacagcaagatcctgggagccttcaacacagtgatcgccctgctcggaagcatcatcatcattgtgatgaacatcatgatcatccagaactacacaagaacaaccgacaaccaggccctgatcaaagaaagcctgcagagcgttcagcagcagatcaaagccctgaccgacaagatcggcaccgaaatcggacctaaggtgtccctgatcgacacctcttctacaatcaccatccccgctaatatcggactgctgggctctaagatcagtcagagcacgagcagcatcaacgagaacgtgaacgacaagtgcaagttcaccctgcctccactgaaaattcatgagtgcaacatcagctgtcctaaccccctgcccttcagagaatacagacctatcagccagggagtttctgatctggtgggcctgccaaatcagatctgcctgcaaaagaccaccagcacaatcctgaagccccgcctgatctcttataccctgcccatcaacacccgggaaggcgtgtgcatcaccgaccctctgctggccgtggacaacggcttcttcgcctacagccacctggaaaagatcggctcttgcaccagaggcatcgcaaagcaaagaatcatcggcgtgggcgaagtgctggaccggggcgataaggtgcccagcatgtttatgaccaacgtgtggacccctcctaaccctagcacaatccaccactgttccagcacctaccacgaggacttctactacaccctgtgcgccgtgagccacgtgggcgaccccatcctgaatagcaccagctggaccgagagcctgagcctgatccggctggccgtgcggcctaagagcgactctggagattacaaccaaaagtacatcgctatcaccaaggtggaacggggcaaatacgataaggtgatgccttacggcccgagcggcatcaaacagggcgacaccctgtacttccctgctgtgggatttctgcctaggaccgagttccagtacaatgacagcaactgccccatcattcactgcaagtattccaaggccgagaactgtagactgagcatgggcgtgaactcaaagtctcactacatcctgagaagcggcctgctgaagtacaacctgagcctgggcggagatatcatcctgcagttcatagagatcgctgataatagactgacaatcggcagcccttctaaaatctacaactccctcggccagcctgtgttctaccaagccagctacagctgggacaccatgatcaagctgggcgatgtggacaccgtggaccctctcagagtgcagtggcggaacaacagcgtgatcagcagacccggccagagccagtgtcctagattcaacgtgtgtcctgaggtgtgctgggagggcacatataatgacgcctttctgattgacagactgaactgggtgtccgccggcgtgtacctgaactctaatcagaccgccgagaaccccgtgttcgccgtctttaaggacaacgagatcctgtaccaagtgccactggctgaagatgatacaaacgcccagaaaacaattacagattgcttcctgcttgagaatgtcatctggtgcatctcgctggtcgagatctacgacaccggcgacagcgtgatcagaccaaagctgttcgccgtgaagatccctgcccagtgcagcgagagctga

SEQ ID NO: 1310 - DNA, 1656 bp, synthetic construct
  misc_feature 1..1656: note = pGP37.1 Newcastle disease virus sequence
  source 1..1656: mol_type = other DNA
atgggcagcagaccttcaaccaagaatcccgctccaatgatgctgacaatccgggtggccctggtcctgtcttgcatctgtcctgctaatagcatcgacggcaggcccctggccgctgcaggcatcgttgtgaccggcgataaggccgtgaacatctacacctcttcacagaccggcagcattatcgtcaagctgctgcctaacctgcccaaggacaaagaggcctgcgccaaggcccctctggatgcctacaaccggaccctgaccaccttactgacacctctgggagatagcatcagacgcatccaggagagcgtgacaaccagcggaggcggcagacagggccggctgatcggagccatcatcggcggcgttgccctgggcgtggctacagccgcacagatcaccgccgccgctgctctgatccaggccaaacagaacgccgccaacatcctgagactgaaggaatccatcgccgcgacgaacgaggccgtgcacgaggtgacagacggcctgtcccagctggctgttgccgtgggcaagatgcagcagttcgtgaacgaccagtttaacaagaccgctcaggagctggactgcattaagatcgcccagcaggtcggcgtggaactgaacctgtacctgacagagctgaccaccgtgttcggacctcagatcacatcccccgctctcaacaaactgacaattcaagccctgtataacctggccggcggcaatatggactacctgctgaccaagctgggcgtgggcaacaaccagctgtctagcctgatcggcagcggcctgatcacaggcaaccccatcctgtacgacagccagacacagctcctcggaatccaggtgaccgcccctagcgtgggaaacctgaacaacatgcgggccacatacctggaaaccctgagcgtgtccaccaccagaggcttcgccagcgcccttgtgcccaaggtggtgacccaagtgggctctgtgatcgaggaactggacacctcctactgtatcgagaccgacctggatctgtactgcaccagaatcgtgacttttcctatgagccctggcatctacagctgcctgagcggcaataccagcgcctgcatgtatagcaagaccgaaggcgccttgaccaccccttacatgaccatcaagggcagcgtgatcgccaactgcaagatgacaacatgccggtgcgtgaaccctccaggcatcatcagccagaactacggcgaagccgtgtctctgatcgacaagcagagctgtaacgtgctgagccttggtgggataaccctgagactgagcggcgagttcgacgtgacctaccagaaaaacatcagcatccaggacagccaggtgatcatcacaggaaatctggatatcagcaccgagctgggcaacgtgaacaattctattagcaacgccctgaacaaactggaagagtccaatagaaagctggacaaagtgaatgtgaagctgacaagcacctctgccctgatcacctacatcgtgctgaccatcatcagcctggtgttcggcatcctgtccctgatcctcgcctgttacctgatgtacaagcaaaaggcccaacagaaaaccctgctgtggctgggcaataacaccctggatcagatgagagccaccacaaag

SEQ ID NO: 1311 - DNA, 1734 bp, synthetic construct
  misc_feature 1..1734: note = pGP37.2 Newcastle disease virus sequence
  source 1..1734: mol_type = other DNA
atggaccgggccgtgagtcaggtggccctggaaaacgacgagagagaggccaagaacacctggcggctgatcttccggatcgccatcctcttcctgaccgtggtgacactggctatttctgtggcctctctgctgtacagcatgggcgctagcacacctagcgacctggtgggcatcccaaccagaatcagcagagctgaagaaaaaatcacctccaccctcggaagcaaccaggacgtggtggacagaatctacaagcaggtggccctggaaagcccactggccctgctcaacaccgagacaaccatcatgaacgccatcaccagcctgagctatcagatcaacggcgctgccaacaacagcggctggggcgcccctatccacgaccccgattacatcggcggaattggcaaggaactgatcgtggatgacgccagcgatgtgacaagcttttaccctagcgcctttcaggagcacctgaacttcattcccgctccaaccaccggcagcggctgcaccagaatccctagcttcgacatgagcgccacccactactgctacacacacaacgtgatcctgtccggctgccgggaccacagccacagctaccaatacctggccctgggtgtgctgagaacctctgccacaggcagagtattcttcagcacactgagatctatcaacctggacgatacccagaacagaaagagctgcagcgtgagcgccacgcccctgggctgtgatatgctgtgctccaaggtgacagaaaccgaggaagaggactacaacagcgccgtgcccaccagaatggtgcacggccggctgggcttcgacggacagtaccacgagaaggatctggatgtgacaaccctgtttggcgactgggtcgccaattaccccggcgttggcggcggctctttcatcgacagccgcgtgtggttcagcgtgtacggcggcctgaaacctaacagcccttccgacaccgtgcaggagggcaagtacgtgatctacaaaagatacaacgacacctgccctgatgagcaggactaccagatcagaatggccaaaagcagctacaagcctggccggttcggcggaaagagaatccagcaggccatcctgtctatcaaggtgtctacctctctgggagaggaccctgtgctgacagtgccacctaataccgtgaccctgatgggcgctgaaggcagaatcctgaccgtgggcaccagccatttcctgtaccaaagaggctcttcatattttagccccgccctgctgtaccctatgacagtgtctaacaaaaccgccacactgcacagcccttatacattcaacgccttcacccggcctggcagcatcccatgtcaggcaagcgctagatgccccaatagctgtgtgaccggagtttacactgatccttaccccctgatcttctaccggaaccacaccctccggggagtctttggcaccatgctggacggagtgcaggccagactgaatcctgctagcgccgtgttcgacagcacctcccggtcccggataacaagagtctctagctccagcaccaaggccgcctacacaacaagcacatgcttcaaggtcgtgaagaccaacaagacatactgtctgagcatcgccgagatctctaataccctgttcggcgagttcagaatcgtgcctctgctggtcgagatcctgaaggacgacggcgtgcgggaagccagaagcggctga

SEQ ID NO: 1312-1535 - skipped (224 entries)

SEQ ID NO: 1536 - DNA, 109 bp, synthetic construct
  misc_feature 1..109: note = scaffold
  source 1..109: mol_type = other DNA
actggcgcttttatctgattactttgagagccatcaccagcgactatgtcgtagtgggtaaagctccctcttcggagggagcatcaaagtatagcatacattatacgaa

SEQ ID NO: 1537 - DNA, 109 bp, synthetic construct
  misc_feature 1..109: note = scaffold
  source 1..109: mol_type = other DNA
actggcgcttttatctgattactttgagagccatcaccagcgactatgtcgtagtgggtaaagctccctcttcggagggagcatcaaagcagcggggatccgacgagct

SEQ ID NO: 1538 - DNA, 161 bp, synthetic construct
  misc_feature 1..161: note = scaffold
  source 1..161: mol_type = other DNA
actggcgcttttatctgattactttgagagccatcaccagcgactatgtcgtagtgggtaaagctgcactatgggcgcagcgtcaatgacgctgacggtacaggccagacaattattgtctggtatagtgcagcatcaaagcgagacgtaattacgtctcg

SEQ ID NO: 1539 - DNA, 161 bp, synthetic construct
  misc_feature 1..161: note = scaffold
  source 1..161: mol_type = other DNA
actggcgcttttatctgattactttgagagccatcaccagcgactatgtcgtagtgggtaaagctgcactatgggcgcagcgtcaatgacgctgacggtacaggccagacaattattgtctggtatagtgcagcatcaaagctgcattctagttgtggttt

SEQ ID NO: 1540 - DNA, 161 bp, synthetic construct
  misc_feature 1..161: note = scaffold
  source 1..161: mol_type = other DNA
actggcgcttttatctgattactttgagagccatcaccagcgactatgtcgtagtgggtaaagctgcactatgggcgcagcgtcaatgacgctgacggtacaggccagacaattattgtctggtatagtgcagcatcaaagtatagcatacattatacgaa

SEQ ID NO: 1541 - DNA, 20 bp, synthetic construct
  misc_feature 1..20: note = spacer
  source 1..20: mol_type = other DNA
tatagcatacattatacgaa

SEQ ID NO: 1542 - DNA, 20 bp, synthetic construct
  misc_feature 1..20: note = spacer
  source 1..20: mol_type = other DNA
cagcggggatccgacgagct

SEQ ID NO: 1543 - DNA, 4566 bp, synthetic construct; identical to SEQ ID NO: 1210
  misc_feature 1..4566: note = pXDP17 sequence
  source 1..4566: mol_type = other DNA

SEQ ID NO: 1544 - DNA, 329 bp, synthetic construct
  misc_feature 1..329: note = guide scaffold
  source 1..329: mol_type = other DNA
actggcgcttttatctgattactttgagagccatcaccagcgactatgtcgtagtgggtaaagctaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctagcatcaaagcgagacgtaattacgtctcg

SEQ ID NO: 1545 - DNA, 329 bp, synthetic construct
  misc_feature 1..329: note = guide scaffold
  source 1..329: mol_type = other DNA
actggcgcttttatctgattactttgagagccatcaccagcgactatgtcgtagtgggtaaagctaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctagcatcaaagctgcattctagttgtggttt

SEQ ID NO: 1546 - DNA, 192 bp, synthetic construct
  misc_feature 1..192: note = guide scaffold
  source 1..192: mol_type = other DNA
actggcgcttttatctgattactttgagagccatcaccagcgactatgtcgtagtgggtaaagctgcactatgggcgcagcaaacatggcagtcctaaggacgcgggttttgctgacggtacaggccacatggcagtcgtaacgacgcgggtggtatagtgcagcatcaaagcgagacgtaattacgtctcg

SEQ ID NO: 1547 - DNA, 179 bp, synthetic construct; identical to SEQ ID NO: 1228
  misc_feature 1..179: note = guide scaffold
  source 1..179: mol_type = other DNA

SEQ ID NO: 1548 - DNA, 192 bp, synthetic construct
  misc_feature 1..192: note = guide scaffold
  source 1..192: mol_type = other DNA
actggcgcttttatctgattactttgagagccatcaccagcgactatgtcgtagtgggtaaagctgcactatgggcgcagcaaacatggcagtcctaaggacgcgggttttgctgacggtacaggccacatggcagtcgtaacgacgcgggtggtatagtgcagcatcaaagctgcattctagttgtggttt

SEQ ID NO: 1549 - DNA, 4566 bp, synthetic construct; identical to SEQ ID NO: 1210
  misc_feature 1..4566: note = pXDP17 sequence
  source 1..4566: mol_type = other DNA

SEQ ID NO: 1550 - DNA, 4563 bp, synthetic construct; identical to SEQ ID NO: 1144
  misc_feature 1..4563: note = pXDP17 sequence
  source 1..4563: mol_type = other DNA

SEQ ID NO: 1551 - DNA, 2465 bp, synthetic construct; identical to SEQ ID NO: 1153
  misc_feature 1..2465: note = pSG17 sequence
  source 1..2465: mol_type = other DNA

SEQ ID NO: 1552 - DNA, 4599 bp, synthetic construct
  misc_feature 1..4599: note = pXDP112 sequence
  source 1..4599: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgccccaaagaagaaaagaaaggtaggaggcagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1553 - DNA, 4659 bp, synthetic construct
  misc_feature 1..4659: note = pXDP114 sequence
  source 1..4659: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgcccctaagaaaaagaggaaagtgggcggatctccgaagaaaaaacggaaggtcggtgggtcacccaagaagaagcggaaggtaggtggctcaccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1554 - DNA, 4719 bp, synthetic construct
  misc_feature 1..4719: note = pXDP116 sequence
  source 1..4719: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgcccctaagaaaaagaggaaagtgggcggatctccgaagaaaaaacggaaggtcggtgggtcacccaagaagaagcggaaggtaggtggctcacctaaaaaaaaacgcaaggttggcgggagccccaaaaaaaagcgaaaggtaggcgggagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1555 - DNA, 4611 bp, synthetic construct
  misc_feature 1..4611: note = pXDP111 sequence
  source 1..4611: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgcccctgccgccaagagagtcaagctcgatggtggcagtccagcggcaaagcgggtgaaacttgactctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1556 - DNA, 4683 bp, synthetic construct
  misc_feature 1..4683: note = pXDP113 sequence
  source 1..4683: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgccccagcggcaaagcgagtaaagttggacggaggttccccagccgccaagagagtcaagctggatggagggtctccagcagcaaagcgcgtaaaactcgacgggggtagtccggccgctaagcgcgtcaaactggactctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1557 - DNA, 4755 bp, synthetic construct
  misc_feature 1..4755: note = pXDP115 sequence
  source 1..4755: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtgccccagctgccaagcgagtcaaacttgatgggggctctcctgccgcaaagagggtaaaattggacggggggagcccagccgcaaagcgagtcaaattggatgggggcagtcccgcagccaaaagggtcaagctcgacggtggcagccctgcggcaaaaagggttaagcttgatggtggttcaccggcagcgaaaagagttaagttggattctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1558 - DNA, 4650 bp, synthetic construct
  misc_feature 1..4650: note = pXDP219 sequence
  source 1..4650: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccgcggccgcggccaaaaggcccgcggccacgaaaaaggccggccaggcaaaaaagaaaaagtctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgagagtaaaaggcccgcggccacgaaaaaggccggccaggcaaaaaagaaaaaggcccccggggagtacccatatgatgtccctgactacgcttga

SEQ ID NO: 1559 - DNA, 4620 bp, synthetic construct
  misc_feature 1..4620: note = pXDP220 sequence
  source 1..4620: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccggtctcgaggccaaaaggcccgcggccacgaaaaaggccggccaggcaaaaaagaaaaagtctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctccaagagaccagccgcaacgaagaaagcaggccaggccaagaaaaagaagtacccatatgatgtccctgactacgcttga

SEQ ID NO: 1560 - DNA, 4761 bp, synthetic construct
  misc_feature 1..4761: note = pXDP223 sequence
  source 1..4761: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcgatggccaaaaggcccgcggccacgaaaaaggccggccaggcaaaaaagaaaaagggcgggtccaagcggccagccgctaccaagaaagcagggcaggcaaagaagaaaaagtctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgagagtaagagaccagccgcaacgaagaaagcaggccaggccaagaaaaagaagggaggttcaaaaaggccagcagccacaaagaaagctggacaagctaagaagaaaaaggcccccggggagtacccatatgatgtccctgactacgct

SEQ ID NO: 1561 - DNA, 4950 bp, synthetic construct
  misc_feature 1..4950: note = pXDP224 sequence
  source 1..4950: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccaaacgcccggcggcgaccaaaaaagcgggccaggcgaaaaaaaaaaaaggcggcagcaagagaccagcggcgaccaagaaggcgggacaagccaagaagaagaagggcggcagcaaaaggcccgcggccacgaaaaaggccggccaggcaaaaaagaaaaagggcgggtccaagcggccagccgctaccaagaaagcagggcaggcaaagaagaaaaagtctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgagagtaagagaccagccgcaacgaagaaagcaggccaggccaagaaaaagaagggaggttcaaaaaggccagcagccacaaagaaagctggacaagctaagaagaaaaagggaggttcaaaacgcccggcggcgaccaaaaaagcgggccaggcgaaaaaaaaaaaaggcggcagcaaacgcccggcggcgaccaaaaaagcgggccaggcgaaaaaaaaaaaatga

SEQ ID NO: 1562 - DNA, 5178 bp, synthetic construct
  misc_feature 1..5178: note = pXDP225 sequence
  source 1..5178: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccaaacggccggcagcgacaaagaaagcggggcaagcaaagaagaaaaaagggggctctaagagacctgcggcaacaaagaaagctgggcaggctaagaagaagaaaggcggcagcaaacgcccggcggcgaccaaaaaagcgggccaggcgaaaaaaaaaaaaggcggcagcaagagaccagcggcgaccaagaaggcgggacaagccaagaagaagaagggcggcagcaaaaggcccgcggccacgaaaaaggccggccaggcaaaaaagaaaaagggcgggtccaagcggccagccgctaccaagaaagcagggcaggcaaagaagaaaaagtctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgagagtaagagaccagccgcaacgaagaaagcaggccaggccaagaaaaagaagggaggttcaaaaaggccagcagccacaaagaaagctggacaagctaagaagaaaaagggaggttcaaaacgcccggcggcgaccaaaaaagcgggccaggcgaaaaaaaaaaaaggcggcagcaaacgcccggcggcgaccaaaaaagcgggccaggcgaaaaaaaaaaaaggcggcagcaaacggccagcggctacgaagaaagcggggcaggcgaagaaaaagaaaggtggttccaagagaccagcagcaactaagaaggctggacaggccaagaagaaaaaatga

SEQ ID NO: 1563 - DNA, 4734 bp, synthetic construct
  misc_feature 1..4734: note = pXDP226 sequence
  source 1..4734: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccctaagaaaaagaggaaagtgggcggatctccgaagaaaaaacggaaggtcggtgggtcacccaagaagaagcggaaggtaggtggctcaccaaagaagaagcggaaggtctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgagagtcctaaaaagaagaggaaggttggggggagtcctaaaaagaaaaggaaggtcggaggatctcctaagaagaagaggaaagttgggggaagcccaaaaaaaaaaagaaaagtctga

SEQ ID NO: 1564 - DNA, 4734 bp, synthetic construct; identical to SEQ ID NO: 1563
  misc_feature 1..4734: note = pXDP227 sequence
  source 1..4734: mol_type = other DNA

SEQ ID NO: 1565 - DNA, 4782 bp, synthetic construct
  misc_feature 1..4782: note = pXDP228 sequence
  source 1..4782: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggcaaagcgagtaaagttggacggaggttccccagccgccaagagagtcaagctggatggagggtctccagcagcaaagcgcgtaaaactcgacgggggtagtccggccgctaagcgcgtcaaactggactctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgagagtccggcggcgaaacgcgtgaaactggatggcggcagcccggcggcgaaacgcgtgaaactggatggcggcagcccggcggcgaaacgcgtgaaactggatggcggcagcccggcggcgaaacgcgtgaaactggattga

SEQ ID NO: 1566 - DNA, 4926 bp, synthetic construct
  misc_feature 1..4926: note = pXDP229 sequence
  source 1..4926: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagctgccaagcgagtcaaacttgatgggggctctcctgccgcaaagagggtaaaattggacggggggagcccagccgcaaagcgagtcaaattggatgggggcagtcccgcagccaaaagggtcaagctcgacggtggcagccctgcggcaaaaagggttaagcttgatggtggttcaccggcagcgaaaagagttaagttggattctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgagagtccggcggcgaaacgcgtgaaactggatggcggcagcccggcggcgaaacgcgtgaaactggatggcggcagcccggcggcgaaacgcgtgaaactggatggcggcagcccggcggcgaaacgcgtgaaactggatggcggcagcccggcggcgaaacgcgtgaaactggatggcggcagcccggcggcgaaacgcgtgaaactggattga

SEQ ID NO: 1567 - DNA, 4611 bp, synthetic construct
  misc_feature 1..4611: note = pXDP230 sequence
  source 1..4611: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcagaccgcggccgcggccaaaaggcccgcggccacgaaaaaggccggccaggcaaaaaagaaaaagtctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgagagtaaaaggcccgcggccacgaaaaaggccggccaggcaaaaaagaaaaagtga

SEQ ID NO: 1568 - DNA, 4722 bp, synthetic construct
  misc_feature 1..4722: note = pXDP231 sequence
  source 1..4722: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccaaaaggcccgcggccacgaaaaaggccggccaggcaaaaaagaaaaagggcgggtccaagcggccagccgctaccaagaaagcagggcaggcaaagaagaaaaagtctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgagagtaagagaccagccgcaacgaagaaagcaggccaggccaagaaaaagaagggaggttcaaaaaggccagcagccacaaagaaagctggacaagctaagaagaaaaagtga

SEQ ID NO: 1569 - DNA, 4635 bp, synthetic construct
  misc_feature 1..4635: note = pXDP237 sequence
  source 1..4635: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccgcggccaaaagggtgaaattggacggagggaagcgcacggccgacggcagtgaattcgagtctccaaagaagaagcgcaaagttgggggtagctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggggggtagcccaaaaaagaagagaaaggtatga

SEQ ID NO: 1570 - DNA, 4641 bp, synthetic construct
  misc_feature 1..4641: note = pXDP238 sequence
  source 1..4641: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccgcggccaaaagggtgaaattggacggagggaagcgcacggccgacggcagtgaattcgagtctccaaagaagaagcgcaaagttcctcctccacccggctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggggggtagcccaaaaaagaagagaaaggtatga

SEQ ID NO: 1571 - DNA, 4656 bp, synthetic construct
  misc_feature 1..4656: note = pXDP239 sequence
  source 1..4656: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccgcggccaaaagggtgaaattggacggagggaagcgcacggccgacggcagtgaattcgagtctccaaagaagaagcgcaaagttggtatccatggagtgcctgcagctcccggctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggggggtagcccaaaaaagaagagaaaggtatga

SEQ ID NO: 1572 - DNA, 4656 bp, synthetic construct
  misc_feature 1..4656: note = pXDP240 sequence
  source 1..4656: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccgcggccaaaagggtgaaattggacggagggaagcgcacggccgacggcagtgaattcgagtctccaaagaagaagcgcaaagttggtggcggctccggcggtggatctcccggctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggggggtagcccaaaaaagaagagaaaggtatga

SEQ ID NO: 1573 - DNA, 4659 bp, synthetic construct
  misc_feature 1..4659: note = pXDP241 sequence
  source 1..4659: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccgcggccaaaagggtgaaattggacggagggaagcgcacggccgacggcagtgaattcgagtctccaaagaagaagcgcaaagttcccggtggcggctccggcggtggatctcccggctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggggggtagcccaaaaaagaagagaaaggtatga

SEQ ID NO: 1574 - DNA, 4683 bp, synthetic construct
  misc_feature 1..4683: note = pXDP242 sequence
  source 1..4683: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccgcggccaaaagggtgaaattggacggagggaagcgcacggccgacggcagtgaattcgagtctccaaagaagaagcgcaaagttgcagaggccgcggcgaaagaggcggccgccaaagaggccgcggccaaagcccccggctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggggggtagcccaaaaaagaagagaaaggtatga

SEQ ID NO: 1575 - DNA, 4632 bp, synthetic construct
  misc_feature 1..4632: note = pXDP243 sequence
  source 1..4632: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccgcggccaaaagggtgaaattggacggagggaagcgcacggccgacggcagtgaattcgagtctccaaagaagaagcgcaaagttcccggctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggggggtagcccaaaaaagaagagaaaggtatga

SEQ ID NO: 1576 - DNA, 4605 bp, synthetic construct
  misc_feature 1..4605: note = pXDP244 sequence
  source 1..4605: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccgcggccaaaagggtgaaattggacggagggagtccaaagaagaagcgcaaagttgggggtagctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggggggtagcccaaaaaagaagagaaaggtatga

SEQ ID NO: 1577 - DNA, 4602 bp, synthetic construct
  misc_feature 1..4602: note = pXDP245 sequence
  source 1..4602: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccgcggccaaaagggtgaaattggaccctccacccccaaagaagaagcgcaaagttcccggctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggggggtagcccaaaaaagaagagaaaggtatga

SEQ ID NO: 1578 - DNA, 4574 bp, synthetic construct
  misc_feature 1..4574: note = pXDP246 sequence
  source 1..4574: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccgcggccaaaagggtgaaattggaccccggcgctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggggggtagcccaaaaaagaagagaaaggtatga

SEQ ID NO: 1579 - DNA, 4623 bp, synthetic construct
  misc_feature 1..4623: note = pXDP247 sequence
  source 1..4623: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccaaagaagaagcggaaggtctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggccccaagcgaactgcagacagccagcactccacacctcctaaaaccaaacgcaaggtggagttcgagcctaagaaaaagcgcaaggtctaa

SEQ ID NO: 1580 - DNA, 4641 bp, synthetic construct
  misc_feature 1..4641: note = pXDP248 sequence
  source 1..4641: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccaaagaagaagcggaaggtctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggaggcggatcagggggcggatcaaagcgaactgcagacagccagcactccacacctcctaaaaccaaacgcaaggtggagttcgagcctaagaaaaagcgcaaggtctaa

SEQ ID NO: 1581 - DNA, 4668 bp, synthetic construct
  misc_feature 1..4668: note = pXDP249 sequence
  source 1..4668: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccaaagaagaagcggaaggtctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtggctgaggcagcagctaaagaagctgcggcgaaagaagccgctgctaaggctaagcgaactgcagacagccagcactccacacctcctaaaaccaaacgcaaggtggagttcgagcctaagaaaaagcgcaaggtctaa

SEQ ID NO: 1582 - DNA, 4653 bp, synthetic construct
  misc_feature 1..4653: note = pXDP250 sequence
  source 1..4653: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccaaagaagaagcggaaggtctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggtcctcccaagaagaagcgcaaggtaggagggtctaagcgaactgcagacagccagcactccacacctcctaaaaccaaacgcaaggtggagttcgagcctaagaaaaagcgcaaggtctaa

SEQ ID NO: 1583 - DNA, 4617 bp, synthetic construct
  misc_feature 1..4617: note = pXDP251 sequence
  source 1..4617: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccaaagaagaagcggaaggtctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggtcctgctgaggcagcagctaaagaagctgcggcgaaagaagccgctgctaaggctccagcggctaaaagggttaagctggactaa

SEQ ID NO: 1584 - DNA, 4602 bp, synthetic construct
  misc_feature 1..4602: note = pXDP252 sequence
  source 1..4602: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccaaagaagaagcggaaggtctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggtcctggtggtggctcaggtggaggcagtgggggaggttccccagcggctaaaagggttaagctggactaa

SEQ ID NO: 1585 - DNA, 4596 bp, synthetic construct
  misc_feature 1..4596: note = pXDP253 sequence
  source 1..4596: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccaaagaagaagcggaaggtctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggtcctcctaagaaaaagcgcaaggtccccccgcccccagcggctaaaagggttaagctggactaa

SEQ ID NO: 1586 - DNA, 4566 bp, synthetic construct
  misc_feature 1..4566: note = pXDP254 sequence
  source 1..4566: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccaaagaagaagcggaaggtctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggtcctccagcggctaaaagggttaagctggactaa

SEQ ID NO: 1587 - DNA, 4698 bp, synthetic construct
  misc_feature 1..4698: note = pXDP255 sequence
  source 1..4698: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccgcggccaaaagggtgaaattggacggagggaagcgcacggccgacggcagtgaattcgagtctccaaagaagaagcgcaaagttgggggtagctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggccccaagcgaactgcagacagccagcactccacacctcctaaaaccaaacgcaaggtggagttcgagcctaagaaaaagcgcaaggtctaa

SEQ ID NO: 1588 - DNA, 4737 bp, synthetic construct
  misc_feature 1..4737: note = pXDP256 sequence
  source 1..4737: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccgcggccaaaagggtgaaattggacggagggaagcgcacggccgacggcagtgaattcgagtctccaaagaagaagcgcaaagttggtggcggctccggcggtggatctcccggctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggaggcggatcagggggcggatcaaagcgaactgcagacagccagcactccacacctcctaaaaccaaacgcaaggtggagttcgagcctaagaaaaagcgcaaggtctaa

SEQ ID NO: 1589 - DNA, 4563 bp, synthetic construct
  misc_feature 1..4563: note = pXDP263 sequence
  source 1..4563: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccaaagaagaagcggaaggtgtctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctccaagagaccagccgcaacgaagaaagcaggccaggccaagaaaaagaagtaa

SEQ ID NO: 1590 - DNA, 4653 bp, synthetic construct
  misc_feature 1..4653: note = pXDP264 sequence
  source 1..4653: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccctaagaaaaagcggaaagtcggcgggtccccaaaaaagaagaggaaagtgggagggtcccccaaaaagaagaggaaggtcggaggcagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctccaagagaccagccgcaacgaagaaagcaggccaggccaagaaaaagaagtaa

SEQ ID NO: 1591 - DNA, 4713 bp, synthetic construct
  misc_feature 1..4713: note = pXDP265 sequence
  source 1..4713: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccaagaagaaaagaaaagttggcggaagccccaagaagaagagaaaagtcggcggtagccctaagaaaaagcggaaagtcggaggcagtccaaaaaagaagaggaaagtgggcgggtctcccaaaaagaagaggaaagtcggcggtagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctccaagagaccagccgcaacgaagaaagcaggccaggccaagaaaaagaagtaa

SEQ ID NO: 1592 - DNA, 4542 bp, synthetic construct
  misc_feature 1..4542: note = pXDP266 sequence
  source 1..4542: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggactctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctccccaaaaaagaagagaaaggtataa

SEQ ID NO: 1593 - DNA, 4569 bp, synthetic construct
  misc_feature 1..4569: note = pXDP267 sequence
  source 1..4569: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggactctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctccaagagaccagccgcaacgaagaaagcaggccaggccaagaaaaagaagtaa

SEQ ID NO: 1594 - DNA, 4605 bp, synthetic construct
  misc_feature 1..4605: note = pXDP268 sequence
  source 1..4605: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggacggcgggtcccccgcagccaagagggtgaaactggattctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctccaagagaccagccgcaacgaagaaagcaggccaggccaagaaaaagaagtaa

SEQ ID NO: 1595 - DNA, 4677 bp, synthetic construct
  misc_feature 1..4677: note = pXDP269 sequence
  source 1..4677: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggacggcgggtcccccgcagccaagagggtgaaactggatggaggctccccagccgcaaagcgggtcaagctggacggagggtcccccgccgctaagagggtgaaactggattctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctccaagagaccagccgcaacgaagaaagcaggccaggccaagaaaaagaagtaa

SEQ ID NO: 1596 - DNA, 4749 bp, synthetic construct
  misc_feature 1..4749: note = pXDP270 sequence
  source 1..4749: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggacggcgggtcccccgcagccaagagggtgaaactggatggaggctccccagccgcaaagcgggtcaagctggacggagggtcccccgccgctaagcgggtcaaactggatggaggcagtcctgcggctaaacgggtcaaactggacggcggtagcccggccgcaaagagggtgaagcttgattctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctccaagagaccagccgcaacgaagaaagcaggccaggccaagaaaaagaagtaa

SEQ ID NO: 1597 - DNA, 4563 bp, synthetic construct
  misc_feature 1..4563: note = pXDP271 sequence
  source 1..4563: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccaaaaggcccgcggccacgaaaaaggccggccaggcaaaaaagaaaaagtctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctccccaaaaaagaagagaaaggtataa

SEQ ID NO: 1598 - DNA, 4623 bp, synthetic construct
  misc_feature 1..4623: note = pXDP322 sequence
  source 1..4623: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggactctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggaggcggatcagggggcggatcaaagcgaactgcagacagccagcactccacacctcctaaaaccaaacgcaaggtggagttcgagcctaagaaaaagcgcaaggtctaa

SEQ ID NO: 1599 - DNA, 4635 bp, synthetic construct
  misc_feature 1..4635: note = pXDP323 sequence
  source 1..4635: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggactctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggtcctcccaagaagaagcgcaaggtaggagggtctaagcgaactgcagacagccagcactccacacctcctaaaaccaaacgcaaggtggagttcgagcctaagaaaaagcgcaaggtctaa

SEQ ID NO: 1600 - DNA, 4593 bp, synthetic construct
  misc_feature 1..4593: note = pXDP324 sequence
  source 1..4593: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggactctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgaccggtggtggtcccgggggtggtgcggccgcaggcagcggaagcccaaaaaagaagagaaaggtaggatccggatcctaa

SEQ ID NO: 1601 - DNA, 4605 bp, synthetic construct
  misc_feature 1..4605: note = pXDP325 sequence
  source 1..4605: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggactctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggccccaagcgaactgcagacagccagcactccacacctcctaaaaccaaacgcaaggtggagttcgagcctaagaaaaagcgcaaggtctaa

SEQ ID NO: 1602 - DNA, 4650 bp, synthetic construct
  misc_feature 1..4650: note = pXDP326 sequence
  source 1..4650: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggactctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtggctgaggcagcagctaaagaagctgcggcgaaagaagccgctgctaaggctaagcgaactgcagacagccagcactccacacctcctaaaaccaaacgcaaggtggagttcgagcctaagaaaaagcgcaaggtctaa

SEQ ID NO: 1603 - DNA, 4578 bp, synthetic construct
  misc_feature 1..4578: note = pXDP327 sequence
  source 1..4578: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggactctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggtcctcctaagaaaaagcgcaaggtccccccgcccccagcggctaaaagggttaagctggactaa

(The sequence listing continues in the following parts.)

What is claimed is:

1. A delivery particle (XDP) system comprising five nucleic acids, wherein the five nucleic acids comprise, from 5' to 3', sequences encoding at least the following components:
   (a) a Gag polyprotein comprising (1) matrix (MA), capsid (CA), nucleocapsid (NC), p1, and p6, and (2) a non-covalent recruitment (NCR) protein, wherein the MA, CA, NC, p1, and p6 are linked by protease cleavage sequences;
   (b) a Gag-transframe region protease polyprotein comprising MA, CA, NC, p1, p6, and a protease, wherein the MA, CA, NC, and p1, p6, and protease are linked by protease cleavage sequences;
   (c) a CRISPR nuclease;
   (d) a tropism factor; and
   (e) a CRISPR guide RNA.

2. The XDP system of claim 1, wherein the protease of the Gag-transframe region protease polyprotein is capable of cleaving the protease cleavage sequences.

3. The XDP system of claim 1, wherein the NCR protein is selected from the group consisting of an MS2 coat protein, a PP7 coat protein, a Qβ coat protein, a protein N, a protein Tat, a phage GA coat protein, an iron-responsive binding element (IRE) protein, and a U1A signal recognition particle.

4. The XDP system of claim 3, wherein the NCR protein is an MS2 coat protein.

5. The XDP system of claim 1, wherein the nucleic acid encoding the CRISPR guide RNA comprises one or more NCR binding partner elements selected from the group consisting of:
   i) a MS2 hairpin;
   ii) a PP7 hairpin;
   iii) a Qβ hairpin;
   iv) a U1 hairpin II;
   v) a boxB;
   vi) a phage GA hairpin;
   vii) a phage AN hairpin;
   viii) an iron response element (IRE); and
   ix) a transactivation response element (TAR).

6. The XDP system of claim 1, wherein the CRISPR nuclease comprises a CasX CRISPR nuclease (CasX).

7. The XDP system of claim 6, wherein the CasX comprises a sequence selected from the group consisting of SEQ ID NOS: 189, 196, 354, or 1901, or a sequence with at least 90% identity thereto.

8. The XDP system of claim 7, wherein the CasX comprises the sequence of SEQ ID NO: 189, or a sequence with at least 90% identity thereto.

9. The XDP system of claim 6, wherein the CasX is a catalytically-dead CasX (dCasX).

10. The XDP system of claim 9, comprising a Krüppel associated box (KRAB) domain operably linked to the dCasX as a fusion protein.

11. The XDP system of claim 1, wherein the CRISPR guide RNA (gRNA) is a single-molecule guide RNA (sgRNA) comprising a scaffold sequence and a targeting sequence, and wherein the targeting sequence comprises 15, 16, 17, 18, 19, or 20 nucleotides, and is complementary to and capable of binding a target nucleic acid sequence.

12. The XDP system of claim 11, wherein the scaffold sequence comprises a scaffold stem loop comprising the sequence of CCAGCGACUAUGUCGUAGUGG (SEQ ID NO: 568).

13. The XDP system of claim 11, wherein the gRNA comprises a scaffold sequence selected from the group consisting of SEQ ID NOS:1959-2010 and SEQ ID NOS: 2238-2377, or a sequence with at least 70% sequence identity thereto.

14. The XDP system of claim 13, wherein the gRNA comprises a scaffold sequence selected from the group consisting of SEQ ID NOS: 1978-2010, 2249, 2286, 2295-2374, and 2380, or a sequence with at least 70% sequence identity thereto.

15. The XDP system of claim 11, wherein the gRNA is capable of complexing with a CasX to form a ribonucleoprotein complex (RNP).

16. The XDP system of claim 1, wherein the tropism factor is selected from the group consisting of a glycoprotein, an antibody fragment, a receptor, and a ligand to a target cell marker or receptor, wherein the encoded tropism factor has binding affinity for a cell surface marker or receptor of a target cell.

17. The XDP system of claim 16, wherein the tropism factor comprises a glycoprotein G from vesicular stomatitis virus (VSV-G).

18. The XDP system of claim 1, comprising 3, 4, or 5 vectors, wherein each vector comprises a nucleic acid encoding one or more components of the XDP system, and a promoter operably linked to the nucleic acid encoding the component.

19. The XDP system of claim 18, wherein the encoded components are capable of self-assembly into a delivery particle (XDP) when the vectors are introduced into a eukaryotic packaging cell and the eukaryotic packaging cell is cultured under conditions allowing for expression of the encoded components.

20. The XDP system of claim 19, wherein upon self-assembly in the eukaryotic packaging cell, the CRISPR nuclease and CRISPR guide RNA components are encapsidated within the delivery particle (XDP), and the tropism factor is incorporated on the surfaces of the delivery particle (XDP).

21. A eukaryotic cell comprising the vectors of claim 18, wherein the eukaryotic cell is a packaging cell.

22. The eukaryotic cell of claim 21, wherein the eukaryotic cell is an HEK293 cell.

23. A kit comprising the XDP system of claim 1 and a suitable container.

* * * * *